US008097439B2

(12) United States Patent
Alibhai et al.

(10) Patent No.: US 8,097,439 B2
(45) Date of Patent: Jan. 17, 2012

(54) METHODS AND COMPOSITIONS FOR PRODUCING FATTY ALDEHYDES

(75) Inventors: Murtaza F. Alibhai, South San Francisco, CA (US); Zhihao Hu, South San Francisco, CA (US)

(73) Assignee: LS9, Inc., South San Francisco, CA (US)

( * ) Notice: Subject to any disclaimer, the term of this patent is extended or adjusted under 35 U.S.C. 154(b) by 0 days.

(21) Appl. No.: 12/575,427

(22) Filed: Oct. 7, 2009

(65) Prior Publication Data

US 2010/0105955 A1 Apr. 29, 2010

Related U.S. Application Data

(60) Provisional application No. 61/103,447, filed on Oct. 7, 2008.

(51) Int. Cl.
*C12P 7/24* (2006.01)

(52) U.S. Cl. .......................................................... 435/147

(58) Field of Classification Search ......................... None
See application file for complete search history.

(56) References Cited

U.S. PATENT DOCUMENTS

| | | | | |
|---|---|---|---|---|
| 5,000,000 | A | 3/1991 | Ingram et al. | |
| 5,028,539 | A | 7/1991 | Ingram et al. | |
| 5,424,202 | A | 6/1995 | Ingram et al. | |
| 5,482,846 | A | 1/1996 | Ingram et al. | |
| 5,602,030 | A | 2/1997 | Ingrahm et al. | |
| 5,807,893 | A | 9/1998 | Voelker et al. | |
| 7,056,714 | B2 * | 6/2006 | Rosazza et al. | 435/189 |
| 7,118,896 | B2 | 10/2006 | Kalscheuer | |
| 7,169,588 | B2 | 1/2007 | Burch et al. | |
| 7,211,418 | B2 * | 5/2007 | Metz et al | 435/134 |
| 7,273,966 | B2 * | 9/2007 | Voelker et al. | 800/281 |
| 7,425,433 | B2 | 9/2008 | Rosazza et al. | |
| 7,608,700 | B2 | 10/2009 | Klaenhammer et al. | |
| 2003/0097686 | A1 | 5/2003 | Knauf et al. | |
| 2003/0129601 | A1 | 7/2003 | Cole | |
| 2003/0233675 | A1 | 12/2003 | Cao et al. | |
| 2004/0180400 | A1 * | 9/2004 | Rosazza et al. | 435/69.1 |
| 2004/0197896 | A1 | 10/2004 | Cole | |
| 2005/0250135 | A1 | 11/2005 | Klaenhammer et al. | |
| 2007/0281345 | A1 | 12/2007 | Binder | |
| 2008/0221310 | A1 | 9/2008 | O'Sullivan et al. | |
| 2008/0295388 | A1 | 12/2008 | Bazzani et al. | |
| 2009/0084025 | A1 | 4/2009 | Bhatia et al. | |
| 2010/0105955 | A1 | 4/2010 | Alibhai et al. | |
| 2010/0105963 | A1 | 4/2010 | Hu | |
| 2010/0154293 | A1 | 6/2010 | Hom et al. | |
| 2010/0221798 | A1 | 9/2010 | Schirmer et al. | |
| 2010/0242345 | A1 | 9/2010 | Keasling et al. | |
| 2010/0249470 | A1 | 9/2010 | Schirmer et al. | |
| 2010/0251601 | A1 | 10/2010 | Hu et al. | |

FOREIGN PATENT DOCUMENTS

| | | | |
|---|---|---|---|
| WO | WO-2007003736 | A1 | 1/2007 |
| WO | WO-2007/136762 | A2 | 11/2007 |
| WO | WO-2008058788 | | 5/2008 |
| WO | WO-2008/0119082 | | 10/2008 |
| WO | WO 2009/042950 | | 4/2009 |
| WO | WO-2009/0140695 | | 11/2009 |
| WO | WO-2009/0140696 | | 11/2009 |
| WO | WO-2010/0042664 | | 4/2010 |
| WO | WO-2010/062480 | A2 | 6/2010 |
| WO | WO 2011/062987 | | 5/2011 |
| WO | WO 2010/075483 | | 7/2011 |

OTHER PUBLICATIONS

Fleischmann et al. Dec. 12, 2006 Database: EMBL, Accession Number: ABK71854.*

Black, et al., "Cloning, Sequencing, and Expression of the fadD Gene of *Escherichia coli* Encoding Acyl Coenzyme A Synthetase*," The Journal of Biological Chemistry, vol. 267, No. 35, Issue of Dec. 1992, pp. 25513-25520, 8 pages.

Caviglia, et al., "Rat Long Chain Acyl-CoA Synthetase 5, but Not 1, 2, 3, or 4, Complements *Escherichia coli* fadD*," The Journal of Biological Chemistry, vol. 279, No. 12, Issue of Mar. 2004, pp. 11163-11169, 7 pages.

Chen, et al., "Biosynthesis of Ansatrienin (mycotrienin) and naphthomycin, Identification and Analysis of Two Separate Biosynthetic Gene Clusters in *Streptomyces collinus* Tu 1892," Eur. J. Biochem. 261, 1999, pp. 98-107, 10 pages.

Cropp, et al., "Identification of a Cyclohexylcarbonyl CoA Biosynthetic Gene Cluster and Application in the Production of Doramectin," Nature Biotechnology, vol. 18, Sep. 2000, 4 pages.

De Mendoza, et al., "Thermal Regulation of Membrane Fluidity in *Escherichia coli*, Effects of Overproduction of β-Ketoacyl-Acyl Carrier Protein Synthase I*," The Journal of Biological Chemistry, vol. 258, No. 4, Issue of Feb. 1983, pp. 2098-2101, 4 pages.

Denoya, et al., "A Second Branded-Chain α-Keto Acid Dehydrogenase Gene Cluster (bkdFGH) from *Streptomyces avermitilis*: Its Relationship to Avermectin Biosynthesis and the Construction of a bkdF Mutant Suitable for the Production of Novel Antiparasitic Avermectins," Journal of Bacteriology, Jun. 1995, pp. 3504-3511, 8 pages.

Han, et al., "A Novel Alternate Anaplerotic Pathway to the Glyoxylate Cycle in Streptomycetes," Journal of Bacteriology, Aug. 1997, pp. 5157-5164, 8 pages.

He, et al., "*Nocardia* sp. Carboxylic Acid Reductase: Cloning, Expression, and Characterization of a New Aldehyde Oxidoreductase Family," Applied and Environmental Microbiology, Mar. 2004, pp. 1874-1881, 8 pages.

Heath, et al., "Lipid Biosynthesis as a Target for Antibacterial Agents," Progress in Lipid Research 40, 2001, pp. 467-497, 31 pages.

Johnson, et al., "Genetic Analysis of the Role of *Saccharomyces cerevisiae* Acyl-CoA Synthetase Genes in Regulating Protein N-Myristoylation*," The Journal of Biological Chemistry, vol. 269, No. 27, Issue of Jul. 1994, pp. 18037-18046, 10 pages.

Knoll, et al., "Biochemical Studies of Three *Saccharomyces cerevisiae* Acyl-CoA Synthetases, Faalp, Faa2p, and Faa3p*," The Journal of Biological Chemistry, vol. 269, No. 23, Issue of Jun. 1994, pp. 16348-16356, 9 pages.

(Continued)

*Primary Examiner* — Nashaat Nashed
(74) *Attorney, Agent, or Firm* — Linda R. Judge; LS9, Inc.

(57) ABSTRACT

Methods and compositions, including nucleotide sequences, amino acid sequences, and host cells, for producing fatty aldehydes are described.

20 Claims, 109 Drawing Sheets

OTHER PUBLICATIONS

Li, et al., "Alteration of the Fatty Acid Profile of *Streptomyces coelicolor* by Replacement of the Initiation Enzyme 3-Ketoacyl Acyl Carrier Protein Synthase III (FabH)," Journal of Bacteriology, Jun. 2005, pp. 3795-3799, 5 pages.

Li, et al., "Purification, Characterization, and Properties of an Aryl Aldehyde Oxidoreductase from *Nocardia* Sp. Strain NRRL 5646," Journal of Bacteriology, Jun. 1997, pp. 3482-3487, 6 pages.

Marrakchi, et al., "A New Mechanism for Anaerobic Unsaturated Fatty Acid Formation in *Streptococcus pneumoniae*\*," The Journal of Biological Chemistry, vol. 277, No. 47, Issue of Nov. 2002, pp. 44809-44816, 6 pages.

Marrakchi, et al., "Mechanistic Diversity and Regulation of Type II Fatty Acid Synthesis," Biochemical Society Transactions, 2002, vol. 30, Part 6, pp. 1050-1055, 6 pages.

Mayer, et al., "Identification of Amino Acid Residues Involved in Substrate Specificity of Plant Acyl-ACP Thioesterases Using a Bioinformatics-guided Approach," BMC Plant Biology, Jan. 2007, 11 pages.

Palaniappan, et al., "Enhancement and Selective Production of Phoslactomycin B, a Protein Phosphatase IIa Inhibitor, through Identification and Engineering of the Corresponding Biosynthetic Gene Cluster'," The Journal of Biological Chemistry, vol. 278, No. 37, Issue of Sep. 2003, pp. 35552-35557, 6 pages.

Patton, et al., "A Novel $\Delta^3\Delta^2$-Enoyl-CoA Isomerase Involved in the Biosynthesis of the Cyclohexanecarboxylic Acid-Derived Moiety of the Polyketide Ansatrienin A," Biochemistry 2000, 39, pp. 7595-7604, 10 pages.

Rock, et al., Increased Unsaturated Fatty Acid Production Associated with a Suppressor of the fabA6(Ts) Mutation in *Escherichia coli*, Journal of Bacteriology, Sep. 1996, vol. 178, No. 18, pp. 5382-5387, 6 pages.

Shockey, et al., "*Arabidopsis* Contains Nine Long-Chain Acyl-Coenzyme A Synthetase Genes that Participate in Fatty Acid and Glycerolipid Metabolism," Plant Physiology, Aug. 2002, vol. 129, pp. 1710-1722, 13 pages.

Zhang, et al., "The FabR (YijC) Transcription Factor Regulates Unsaturated Fatty Acid Biosynthesis in *Escherichia coli*\*," The Journal of Biological Chemistry, vol. 277, No. 18, Issue of May 2002, pp. 15558-15565, 8 pages.

Doss, R., P. et al., "Composition and Enzymatic Activity of the Extracellular Matrix Secreted by Germlings of Botrytis Cinerea," Applied and Environmental Microbiology, Feb. 1999, vol. 65(2), pp. 404-408.

International Search Report and Written Opinion of the International Searching Authority of the United States Patent and Trademark Office for PCT/US2009/059903, mailing date of Jun. 2, 2010, 13 pages.

International Search Report and Written Opinion of the International Searching Authority of the United States Patent and Trademark Office for PCT/US2009/59904, mailing date of Apr. 5, 2010, 11 pages.

NCBI Reference Sequence YP_889972.1, Putative Long-Chain Fatty-Acid-CoA Ligase [*Mycobacterium smegmatis* Str. MC2 155], retrieved from http://www.ncbi.nim.nih.gov/protein/118469671, 4 pages.

Venkitasubramanian, et al., "Reduction of Carboxylic Acids by Nocardia Aldehyde Oxidoreductase Requires a Phosphopantetheinylated Enzyme," J. Biol. Chem., 2007, vol. 282, No. 1, pp. 478-485.

Atsumi, et al., "Non-fermentative Pathways for Synthesis of Branched-chain Higher Alcohols as Biofuelds," Nature, vol. 451, Jan. 2008, 5 pages.

Bergler, et al., "Protein EnvM Is the NADH-dependent Enoyl-ACP Reductase (FabI) of *Escherichia coli*\*," The Journal of Biological Chemistry, vol. 269, No. 8, Issue Feb. 1994, pp. 5943-5946, 4 pages.

Campbell, et al., "A New *Escherichia coli* Metabolic Competency: Growth on Fatty Acids by a Novel Anaerobic β-oxidation Pathway," Molecular Microbiology, 2003, 47(3), pp. 793-805, 13 pages.

Database EMBL (Online), Jul. 1996, "*Synechococcus*, PCC7942 Ribosomal Protein S1 of 30S Ribosome (rpsl), ORF271, ORF231, ORF341, Carboxyltransferase alpha subunit (accA), ORF245, ORF227, and GTP cyclohydrolase I (folE) genes, complete cds, and ORF205 gene, partial cds.," XP002564232, 4 pages.

Database UniProt, Online, Nov. 1996, XP002545841, Retrieved from EBI Accession No. Uniprot:Q54764, 1 page.

Database UniProt, Online, Nov. 1996, XP002564231, Retrieved from EBI Accession No. UNIPROT:Q54765, 1 page.

Datsenko, et al., "One-step Inactivation of Chromosomal Genes in *Escherichia coli* K-12 using PCR Products," Proc. Natl. Acad. Sci, USA 97, 2000, pp. 6640-6645, 6 pages.

Fehler, et al., Biosynthesis of Hydrocarbons in *Anabaena variabilis*. Incorporation of [*methyl*-$^{14}$C]- and [*methyl*-$^2$H$_2$] Methionine into 7- and 8-Methylheptadecanes\*, Biochemistry, vol. 9, No. 2, Jan. 1970, pp. 418-422.

Han, et al., "Biosynthesis of Alkanes in Nostoc Muscorum," Journal of the American Chemical Society, 91:18, Aug. 1969, pp. 5156-5159.

Hoffmeister, et al., "*Mitochondrial trans*—2-Enoyl-CoA Reductase of Wax Ester Fermentation from *Euglena gracilis* Defines a New Family of Enzymes Involved in Lipid Synthesis\*," The Journal of Biological Chemistry, vol. 280, No. 6, Issue of Feb. 2005, pp. 4329-4338, 10 pages.

International Search Report and Written Opinion of the Searching Authority of the European Patent Office for PCT/US2009/044403, mailing date Sep. 25, 2009, 12 pages.

International Search Report of the International Searching Authority of the European Patent Office for PCT/US2009/044409, mailing date Jan. 29, 2010, 4 pages.

Inui, et al., "Fatty Acid Synthesis in Mitochondria of *Euglena gracilis*," Eur. J. Biochem. 142, 1984, pp. 121-126, 6 pages.

Jiang, et al., "Inhibition of Fatty Acid Synthesis in *Escherichia coli* in the Absence of Phospholipid Synthesis and Release of Inhibition by Thioesterase Action," Journal of Bacteriology, vol. 176, No. 10, May 1994, pp. 2814-2821.

Juttner, et al., "Environmental Factors Affecting the Formation of Mesityloxide, Dimethylallylic Alcohol and Other Volatile Compounds Excreted by *Anabaena cylindrica*," Journal of General Microbiology, 1983, 129, 407-412, 6 pages.

Juttner, et al., The reducing capacities of cyanobacteria for aldehydes and ketones, Applied Microbiology and Biotechnology, 25: 52-54, 1986, 3 pages.

Kalscheuer, et al., "Microdiesel: *Escherichia coli* Engineered for Fuel Production," Microbiology, 2006, 152, pp. 2529-2536.

Ladygina, et al., "A Review of Microbial Synthesis of Hydrocarbons," Process Biochemistry, 41, 2006, pp. 1001-1014.

Lykidis, et al., "Genomic Prospecting for Microbial Biodiesel Production," NN, Jun. 2008, 41 pages.

Mackey, et al., "Detection of Rhythmic Bioluminescense from Luciferase Reporters in Cyanobacteria," Methods in Molecular Biology, vol. 362, 2007, 16 pages.

Morgan-Kiss et al., The *Escherichia coli fadK (ydiD)* Gene Encodes an Anerobically Regulated Short Chain Acyl-CoA Synthetase\*, The Journal of Biological Chemistry, vol. 279, No. 36, Sep. 2004, pp. 37324-37333.

Morgan-Kiss, et al., "The *Lactococcus lactis* FabF Fatty Acid Synthetic Enzyme can Functionally Replace both the FabB and FabF Proteins of *Escherichia coli* and the FabH Protein of *Lactococcus lactis*," Arch Microbiol., 2008, 190, pp. 427-437, 11 pages.

Naccarato, et al., "In Vivo and in Vitro Biosynthesis of Free Fatty Alcohols in *Excherichia coli* K-12," Lipids vol. 9, No. 6, 1973, 10 pages.

Partial International Search Report from the International Search Authority of the European Patent Office, for PCT/US2008/058788, mailing date May 11, 2008, 4 pages.

Reiser, et al., "Isolation of Mutants of *Acinetobacter calcoaceticus* Deficient in Wax Ester Synthesis of Complementation of One Mutation with a Gene Encoding a Fatty Acyl Coenzyme A Reductase," Journal of Bacteriology, May 1997, pp. 2969-2975, 7 pages.

Spencer, et al., "Thioesterases I and II of *Escherichia coli*," The Journal of Biological Chemistry, vol. 253, No. 17, Issue Sep. 1978, pp. 5922-5926, 5 pages.

Tucci, et al., "A Novel Prokaryotic *trans*—2-enoyl-CoA reductase from the Spirochete *Treponema denticola*," FEBS Letters 581, 2007, pp. 1561-1566, 6 pages.

Voelker, et al., "Alteration of the Specifity and Regulation of Fatty Acid Synthesis of *Escherichia coli* by Expression of a Plant Medium- Chain Acyl-Acyl Carrier Protein Thioesterase," Journal of Bacteriology, vol. 176, No. 23, Dec. 1994, pp. 7320-7327.
Yuan-Zheng, et al., Metabolic Engineering of *Aeromonas hydrophila* for the Enhanced Production of poly(3-hydroxybutyrate-co-3-hydroxyhexanoate), Appl. Microbiol. Biotechnol., 2006, 69, pp. 537-532.
Zang, et al., "Optimum Conditions for Transformation of *Synechocystis* sp. PCC 6803," The Journal of Microbiology, Jun. 2007, vol. 45, No. 3, pp. 241-245.
Zhang, et al., "Molecular Effect of FadD on the Regulation and Metabolism of Fatty Acid in *Escherichia Coli*," FEMS Microbiol Lett, 259, 2006, pp. 249-253.
Zheng, et al., "Thioesterase II of *Escherichia coli* Plays an Important Role in 3-Hydroxydecanoic Acid Production," Applied and Environmental Microbiology, vol. 70, No. 7, Jul. 2004, pp. 3807-3813, 7 pages.
Chang et al.,:Genetic and Biochemical Analysis of *Escherichia Coli* Strains Having a Mutation in the Structural Gene (poxB) for Pyruvate Oxidase, J. Bacteriol. 154 (2):756-62 (1983).
Mat-Jan et al., "Mutants of *Escherichia coli* Deficient in the Fermentative Lactate Dehydrogenase," J. Bacteriol. 171(1):342-8 (1989).
Bunch et al., "The IdhA gene encoding the fermentative lactate dehydrogenase of *Escherichia coli*," Microbiol. 143(1):187-95 (1997).
Abdel-Hamid et al., "Pyruvate oxidase contributes to the aerobic growth efficiency of *Escherichia coli* ," Micribiol. 147 (6):1483-98 (2001).
Knothe, G. "Dependence of biodiesel fuel properties on the structure of fatty acid alkyl esters," Fuel Processing Technology 86:1059-1070, 2005.
McCue, L. et al., "Phylogenetic footprinting of transcription factor binding sites in proteobacterial genomes," Nucleic Acids Res., 29(3):774-82 (2001).
Jarboe, L.R. et al., "Development of Ethanologenic Bacteria," Adv. Biochem. Engin./Biotechnol. 108:237-261 (2007).
Peterson & Ingram, "Anaerobic Respiration in Engineered *Escherichia coli* with an Internal Electron Acceptor to Produce Fuel Ethanol," Ann. N. Y. Acad. Sci. 1125:363-372 (2008).
Yomano, L.P. et al., "Re-Engineering *Escherichia coli* for ethanol production," Biotechnol. Lett. 30:2097-2103 (2008).
Cheng, J. et al., "Mammalian Wax Biosynthesis," J. Biol. Chem. 279(36):37798-37807, 2004.
Kalscheuer, R. And Steinbuchel, A., "A Novel Bifunctional Wax Ester Synthase/Acyl-CoA:Diacylglycerol Acyltransferase Mediates Wax Ester and Triacylglycerol Biosynthesis in *Acinetobacter calcoaceticus* ADPI," J. Biol. Chem. 278:8075-8082, 2003.
Cho, H. et al., "Defective Export of a Periplasmic Enzyme Disrupts Regulation of Fatty Acid Synthesis," J. Biol. Chem., 270:4216-4219 (1995).
Abbadi et al., "Knockout of the regulatory site of 3-ketoacyl-ACP synthase III enhances short-and medium-chain acyl-ACP synthesis", *Plant Journal*, 24(1): 1-9 (2000).
Abdel-Hamid et al., "Coordinate Expression of the Acetyl Coenzyme A Carboxylase Genes, accB and accC, Is Necessary for Normal Regulation of Biotin Synthesis in *Escherichia coli", J. Bacteriol.*, 189:369-376 (2007).
Alper, et al., "Engineering for biofuels: exploiting innate microbial capacity or importing biosynthetic potential?", *NRM 7*: 715-723 (2009).
Atsumi et al., "Metabolic engineering for advanced biofuels production from *Escherichia coli", Current Opin.Biotech*, 19:414-419 (2008).
Atsumi et al., "Metabolic engineering of *Escherichia coli* for 1-butanol production", *Metabolic Enginering 10*:305-311 (2008).
Atsumi et al., "Non-fermentative pathways for synthesis of branched-chain higher alcohols as biofuels", *Nature*, 451: 86-89 (2008).
Barnes, Jr. et al., "Studies on the Mechanism of Fatty Acid Synthesis. XIX. Preparation and General Properties of Palmityl Thioesterase", *J. Biol. Chem.*, 243(11):2955-2962 (1968).
Bergler et al., "Protein EnvM is the NADH-dependent Enoyl-ACP Reductase (Fabl) of *Escherichia coli," J. Biol. Chem.*, 269(8): 5943-5946 (1994).
Bergler et al., "The enoyl-[acyl-carrier-protein] reductase (Fabl) of *Escherichia coli*, which catalyzes a key regulatory step in fatty acid biosynthesis, accepts NADH and NADPH as cofactors and is inhibited by palmitoyl-CoA", *Eur. J. Biochem. 242*: 689-694 (1996).
Berrios-Rivera et al., "The Effect of Increasing NADH Availability on the Redistribution of Metabolic Fluxes in *Escherichia coli* Chemostat Cultures", *Metabolic Engineering 4*: 230-237 (2002).
Birge et al., "Acyl Carrier Protein. XVI.Intermediate Reactions of Unsaturated Fatty Acid Synthesis in *Escerichia Coli* and Studies of fab B Mutants", J.Biol.Chem. 247(16): 4921-4929 (1972).
Black et al., "Cloning, Sequencing, and Expression of the fadD Gene of *Escherichia Coli* Encoding Acyl Coenzyme A Synthetase," *J. Biol. Chem.* 267(35): 25513-25520 (1992).
Black, P., "Primary Sequence of the *Escherichia coli fadL* Gene Encoding an Outer Membrane Protein Required for Long-Chain Fatty Acid Transport", *J. Bacteriololgy 173*(2): 435-442 (1991).
Black et al., "Mutational Analysis of a Fatty Acyl-Coenzyme A Synthetase Signature Motif Identifies Seven Amino Acid Residues That Modulate Fatty Acid Substrate Specificity", *J. Biol. Chem. 272*(8) 4896-4903 (1997).
Black et al., "Long-Chain Acyl-CoA—Dependent Regulation of Gene Expression in Bacteria, Yeast and Mammals", *J. Nutrition*, 305S-309S (2000).
Blanchard et al., "Overexpression and Kinetic Characterization of the Carboxyltransferase Component of Acetyl-CoA Carboxylase", *J.Biol.Chem. 273*(30): 19140-19145 (1998).
Bonamore et al., "The desaturase from *Bacillus subtilis*, a promising tool for the selective olefination of phospholipids", *J.Biotechnology 121*: 49-53 (2006).
Bond-Watts et al., "Enzyme mechanism as a kinetic control element for designing synthetic biofuel pathways", *Nature Chem Bio 537*: 1-6 (Suppl. S1-S28) (2011).
Bonner et a.l, "Purification and Properties of Fatty Acyl Thioesterase I from *Escherichia coil*", *J.Biol.Chem. 247*(10): 3123-3133 (1972).
Boonstra et al., "The udhA Gene of *Escherichia coli* Encodes a Soluble Pyridine Nucleotide Transhydrogenase", *J.Bacteriol. 181*(3): 1030-1034 (1999).
Boulanger et al., "Purification and Structrual and Functional Characterization of FhuA, a Transporter of the *Escherichia coli* Outer Membrane," *Biochemistry*, 35(45): 14216-14224 (1996).
Bredwell et al., "Reactor Design Issues for Synthesis-Gas Fermentations", *Biotechnol. Prog. 15*: 834-844 (1999).
Broun et al., "Catalytic Plasticity of Fatty Acid Modification Enzymes Underlying Chemical Diversity of Plant Llipids", *Science 282*: 1315-1317 (1998).
Cahoon et al., "Modification of the Fatty Acid Composition of *Escherichia coli* by Coexpression of a Plant Acyl-Acyl Carrier Protein Desaturase and Ferredoxin", *J.Bacteriol. 178*(3): 936-936 (1996).
Cahoon et al., "Redesign of soluble fatty acid desaturases from plants for altered substrate specificity and double bond position", *Proc. Natl. Acad. Sci.94*: 4872-4877 (1997).
Cahoon et al., "A Determinant of Substrate Specificity Predicted from the Acyl-Acyl Carrier Protein Desaturase of Developing Cat's Claw Seed", *Plant Physiol 117*: 593-598 (1998).
Campbell et al., The Enigmatic *Escherichia coli neu* Gene is *yafH' J. Bacteriol.*, 184(13): 3759-3764 (2002).
Campbell et al., "A New *Escherichia coli* metabolic competency: growth on fatty acids by a novel anaerobic β-oxidation pathway," *Mol. Microbiol.*, 47(3): 793-805 (2003).
Campbell et al., "*Escherichia coli* FadR Positively Regulates Transcription of the fabB Fatty Acid Biosynthetic Gene", *J.Bacteriol. 183*(20): 5982-5990 (2001).
Caviglia et al., "Rat Long Chain Acyl-CoA Synthetase 5, but Not 1, 2, 3, or 4, Complements *Escherichia coli fadD," J. Biol. Chem.*, 279(12): 11163-11169 (2004).
Chang et al., "Genetic and Biochemical Analyses of *Escherichia Coli* Strains Having a Mutation in the Structural Gene (poxB) for Pyruvate Oxidase," *J. Bacteriol.*, 154(4: 756-62 (1983).
Cho et al., "Defective Export of a Periplasmic Enzyme Disrupts Regulation of Fatty Acid Synthesis," *J. Biol. Chem.*, 270: 4216-4219 (1995).

Cho et al., "*Escherichia coli* Thioesterase I, Molecular Cloning and Sequencing of the Structural Gene and Identification as a Periplasmic Enzyme", *J.Biol.Chem 268*(13:5): 9238-9245 (1993).
Cho et al., "Transcriptional regulation of the *fad* regulon genes of *Escherichia coli* by ArcA", *Microbiology 152*: 2207-2219 (2006).
Choi et al., "β-Ketoacyl-acyl Carrier Protein Synthase III (FabH) Is a Determining Factor in Branched-Chain Fatty Acid Biosynthesis" *J. of Bacteriology* 182(2): 365-370 (2000).
Coleman et al., "Enzymes of triacylglycerol synthesis and their regulation" *Progress in Lipid Research 43*:134-176 (2004).
Collister et al., "Modification of the petroleum system concept: Origins of alkanes and isoprenoids in crude oils" *AAPG Bulletin 88*(5):587-611 (2004).
Conway et al., "Cloning and Sequencing of the Alcohol Dehydrogenase II Gene from *Zymomonas mobilis" J. Bacteriol. 169*(6): 2591-2597 (1987).
da Silva et al., "Comparison of the Genomes of Two *Xanthomonas* Pathogens with Differing Host Specificities" *Nature*, 417: 459-463 (2002).
Davis et al., "Inhibition of *Escherichia coli* Acetyl Coenzyme A Carboxylase by Acyl-Acyl Carrier Protein" *J.Bacteriol. 183*(4): 1499-1503 (2001).
Dehesh et al., "KAS IV: A 3-ketoacyl-ACP synthase from *Cuphea sp.* Is a medium chain specific condensing enzyme", *The Plant Journal 15*(3)383-390 (1998).
Dehesh et al., "Production of high levels of 8:0 and 10:0 fatty acids in transgenic canola by overexpression of *Ch FatB2*, a thioesterase cDNA from *Cuphea hookeriana" The Plant Journal 9*(2): 167-172 (1996).
Delay et al., "In Vivo Functional Analyses of the Type II Acyl Carrier Proteins of Fatty Acid Biosynthesis", *J.Biol.Chem. 282*: 20319-20328 (2007).
Demendoza et al., "Thermal Regulation of Membrane Fluidity in *Escherichia coli*. Effects of Overproduction of P-Ketoacylacyl Carrier Protein Synthase 1", *J.Biol.Chem. 258*(4):2098-2101 (1983).
Deveaux et al., "Genetic and Biochemical Characterization of a Mutation (*fatA*) That Allows *trans* Unsaturated Fatty Acids to Replace the Essential *cis* Unsaturated Fatty Acids of *Escherichia coli" J.Bacteriol. 171*(3)1562-1568 (1989).
Doan et al., "Functional expression of five *Arabidopsis* fatty acyl-CoA reductase genes in *Escherichia coli"J. Plant Physiology 166*:787-796 (2009).
Domergue et al., "Acyl Carriers Used as Substrates by the Desaturases and Elongases Involved in Very Long-chain Polyunsaturated Fatty Acids Biosynthesis Reconstituted in Yeast" *J.Biol.Chem 278*(37):35115-35126 (2003).
Domka et al., "YliH (BssR) and YceP (BssS) Regulate *Escherichia coli* K-12 Biofilm Bormation by Influencing Cell Signaling" *Appl. and Environ. Microbiol. 72*(4):2449-2459 (2006).
Doss, R.P., "Composition and Enzymatic Activity of the Extracellular Matrix Secreted by Germlings of *Botrytis cinerea," Appl. and Environ. Microbiol.*, 65(2): 404-408 (1999).
Farewell et al., "Role of the *Escherichia coli* FadR Regulator in Stasis Survival and Growth Phase-Dependent Expression of the *uspA, fad*, and *fab* Genes", *J. Bacteriol. 178*(22): 6443-6450 (1996).
Fehler et al., "Biosynthesis of Hydrocarbons in *Anabaena variabilis*. Incorporation of [*methyl*-$^{14}$C]- and [*methyl*-$^{2}H_3$] Methionine into 7- and 8-Methylheptadecances", *Biochemistry 9*(2): 418-422 (1970).
Feng et al., "A New Member of the *Escherichia coli* fad Regulon: Transcriptional Regulation of *fadM* (*ybaW*)", *J. Bacteriol. 191*(20): 6320-6328 (2009).
Feng et al., "Overlapping Repressor Binding Sites Result in Additive Regulation of *Escherichia coli* FadH by FadR and ArcA" *J. of Bacteriology 192*(17):4289-4299 (2010).
Feng et al., "*Escherichia coli* Unsaturated Fatty Acid Synthesis: Complex Transcription of the fabA Gene and in Vivo Identification of the Essential Reaction Catalyzed by FabB", *J.Biol.Chem. 284*(43): 29526-29535 (2009).
Fischer et al., "Selection and optimization of microbial hosts for biofuels production" *Metabolic Engineering 10*:295-304 (2008).
Fleischman et al., Accession No. YP_889972/GI:11849671 (2006).
Fozo et al., "The fabM Gene Product of *Streptococcus mutans* Is Responsible for the Synthesis of Monounsaturated Fatty Acids and Is Necessary for Survival at Low pH", *J. Bacteriol. 186*(13): 4152-4158 (2004).
Ghisla et al., Acyl-CoA dehydrogenases—A mechanistic overview, *Eur. J. Biochem. 271*: 494-508 (2004).
Hamilton-Kemp et al., "Production of the Long-Chain Alcohols Octanol, Decanol, and Dodecanol by *Escherichia coli", Current Microbiology 51*: 82-86 (2005).
Heath et al., "Regulation of Malonyl-CoA Metabolism by Acyl-Acyl Carrier Protein and βKetoacyl-Acyl Carrier Protein Synthases in *Escherichia coli", J.Biol.Chem. 270*(26)1 5531-15538 (1995).
Heath et al., "Regulation of Fatty Acid Elongation and Initiation by Acyl-Acyl Carrier Protein in *Escherichia coli", J.Biol.Chem.* vol. 271(4):1833-1836 (1996).
Heath et al., "Inhibition of β-Ketoacyl-Acyl Carrier Protein Synthase III (FabH) by Acyl-Acyl Carrier Protein in *Escherichia coli", J.Biol. Chem.271*(18):10996-11000 (1996).
Heath et al., "Roles of the FabA and FabZ β-Hydroxyacyl-Acyl Carrier Protein Dehydratases in *Escherichia coli* Fatty Acid Biosynthesis", *J.Biol.Chem. 271*(44): 27795-27801 (1996).
Henry et al., "*Escherichia coli* Transcription Factor That Both Activates Fatty Acid Synthesis and Represses Fatty Acid Degradation", *J. Mol. Biol. 222*: 843-849 (1991).
Hu et al., Microalgal triacylglycerols as feedstocks for biofuel production: perspectives and advances, *The Plant Journal 54*: 621-639 (2008).
Hunt et al., "Characterization of an Acyl-CoA Thioesterase That Functions as a Major Regulator of Peroxisomal Lipid Metabolism" *J.Biol.Chem. 277*(2):1128-1138 (2002).
Jayakumar et al.,"Cloning and expression of the multifunctional human fatty acid synthase and its subdomains in *Escherichia coli",PNAS 93*: 14509-14514 (1996).
Jones et al., "Palmitoyl-Acyl Carrier Protein (ACP) Thioesterase and the Evolutionary-Origin of Plant Acyl-ACP Thioesterases", *Plant Cell*, vol. 7:359-371 (1995).
Kalscheuer et al., "Neutral Lipid Biosynthesis in Engineered *Escherichia coli*: Jojoba Oil-Like Wax Esters and Fatty Acid Butyl Esters", *Appl.Environ.Microbiol. 72*(2): 1373-1379 (2006).
Kalscheuer et al., "Analysis of Storage Lipid Accumulation in *Alcanivorax borkumensis*:Evidence for Alternative Triacylglycerol Biosynthesis Routes in Bacteria," *J.Bacteriology 189*(3): 918-923 (2007).
Kameda et al., "Further purification, characterization and salt activation of acyl-CoA synthetase from *Escherichia coli", Biochimica et Biophysica Acta 840*: 29-36(1985).
Keasling et al., "Metabolic engineering delivers next-generation biofuels", *Nature Biotechology 26*(3):298-299 (2008).
Knudsen et al,. "Transacylation as a chain-termination mechanism in fatty acid synthesis by mammalian fatty acid synthetase. Synthesis of medium-chain-length (C8-C12) acyl-CoA esters by goat mammary-gland fatty acid synthetase", *Biochem. J. 202*: 139-143 (1982).
Koffas, M.A.G., "Expanding the repertoire of biofuel alternatives through metabolic pathway evolution", *PNAS 106*(4): 965-966 (2009).
Kumari et al., "Regulation of Acetyl Coenzyme A Synthetase in *Escherichia coil", J. Bacteriol. 182*(15): 4173-4179 (2000).
Lang et al., "Preparation and characterization of bio-diesels from various bio-oils", *Bioresource Tech. 80*: 53-62 (2001).
Lee et al., "Enhanced preference for Π-bond containing substrates is correlated to Pro110 in the substrate-binding tunnel of *Escherichia coli* thioesterase I/protease I/lysophospholipase $L_1$" *Biochim. Et Biophys. Acta*, 1774: 959-967 (2007).
Lee et al., "Metabolic engineering of microorganisms for biofuels production: from bugs to synthetic biology to fuels", *Current Opinion in Biotechnology 19*: 556-563 (2008).
Lennen et al., "A Process for Microbial Hydrocarbon Synthesis: Overproduction of Fatty Acids in *Escherichia coli* and Catalytic Conversion to Alkane", *Biotech.Bioengineering 106*(2)1 93-202 (2010).

Leonard et al., "A Cuphea β-ketoacyl-ACP synthase shifts the synthesis of fatty acids towards shorter chains in *Arabidopsis* seeds expressing *Cuphea* FatB thioesterases", *Plant Journal 13*(5): 621-628 (1998).
Li et al., "The Gene Encoding the Biotin Carboxylase Subunit of *Escherichia coli* Acetyl-CoA carboxylase", *J.Biol.Chem. 267*(2): 855-863 (1992).
Li et al., "The carboxylic acid reduction pathway in *Nocardia*. Purification and characterization of the aldehyde reductase", *J. of Industrial Microbiology & Biotechnology 25*: 328-332 (2000).
Li et al., "Conversion of Fatty Aldehydes to Alka(e)nes and Formate by a Cyanobacterial Aldehyde Decarbonylase: Cryptic Redox by an Unusual Dimetal Oxygenase", *J. Am. Chem. Soc. 133*: 6158-6161 (2011).
Li et al., "Growth Rate Regulation of *Escherichia coli* Acetyl Coenzyme A Carboxylase, Which Catalyzes the First Committed Step of Lipid Biosynthesis", *J. Bacteriol. 175*(2): 332-340 (1993).
Link et al., "Methods for Generating Precise Deletions and Insertions in the Genome of Wild-Type *Escherichia coli*: Application to Open Reading Frame Characterization", *J.Bacteriol. 179*(20): 6228-6237 (1997).
Liu, et al., "Production and secretion of fatty acids in genetically engineered cyanobacteria" *PNAS Early Edition*: 1-6 (2010).
Lu et al., "Overproduction of free fatty acids in *E. coli*: Implications for biodiesel production", *Metabolic Engineering 10*: 333-339 (2008).
Magnuson et al., "Regulation of Fatty Acid Biosynthesis in *Escherichia coli" Microbiol.Reviews 57*(3): 522-542 (1993).
Marr, et al., "Effect of Temperature on the Composition of Fatty Acids in *Escherichia Coli", J.Bacteriol. 84*: 1260-1267 (1962).
Massengo-Tiasse et al., "Vibrio neumon FabV Defines a New Class of Enoyl-Acyl Carrier Protein Reductase", *J.Biol.Chem. 283*(3): 1308-1316 (2008).
Mayer et al., "Identification of amino acid residues involved in substrate specificity of plant acyl-ACP thioesterases using a bioinformatics-guided approach" *BMC Plant Biology 7*(1) (2007).
Metz et al., "Purification of a Jojoba Embryo Fatty Acyl-Coenzyme A Reductase and of Its cDNA in High Erucic Acid Rapeseed", *Plant Physiol. 122*: 635-644 (2000).
Metzgar et al., "*Acinetobacter sp.* ADP1: An ideal model organism for genetic analysis and genome engineering", *Nucleic Acid Res. 32*(19):5780-5790 (2004).
Mohan et al., "An *Escherichia coli* Gene (FabZ) Encoding (3*R*)-Hydroxymyristoyl Acyl Carrier Protein Dehydrase. Relation to fubA and Suppression of Mutations in Lipid a Biosynthesis", *J.Biol.Chem 269*(52): 32896-32903 (1994).
Morgan-Kiss et al, "The *Escherichia coli* fadK (ydiD) Gene Encodes an Anerobically Regulated Short Chain Acyl-CoA Synthetase," *J. Biol. Chem.*, 279(36): 37324-37333 (2004).
Morgan-Kiss et al., "The *Lactococcus lactis* FabF Fatty Acid Synthetic Enzyme can Functionally Replace both the FabB and FabF Proteins of *Escherichia coli* and the FabH Protein of *Lactococcus lactis," Arch. Microbiol. 190*: 427-437 (2008).
Nunn et al., "Transport of long-chain fatty acids by *Escherichia coli*: Mapping and characterization of mutants in the *fadL* gene" *PNAS* 75(7): 3377-3381 (1978).
Nunn et al., "Role for fadR in Unsaturated Fatty Acid Biosynthesis in *Escherichia coli", J.Bacteriol. 154*(2):554-560 (1983).
Peng et al., "Effect of *fadR* gene knockout on the metabolism of *Escherichia coli* based on analyses of protein expressions, enzyme activities and intracellular metabolite concentrations" *Enzyme and Microbial Tech. 38*: 512-520 (2006).
Perez et al., "*Escherichia coli* YqhD Exhibits Aldehyde Reductase Activity and Protects from the Harmful Effect of Lipid Peroxidation-derived Aldehydes" *J.Biol.Chem. 283*(12): 7346-7353 (2008).
Pillai et al., "Functional characterization of β-ketoacyl-ACP reductase (FabG) from *Plasmodium falciparum" Biochem. And Biophysical Research Comm. 303*: 387-392 (2003).
Qiu et al., "Crystal structure and substrate specificity of the β-ketoacyl-acyl carrier protein synthase III (FabH) from *Staphylococcus aureus", Protein Science 14*: 2087-2094 (2005).
Rafi et al., "Structure of Acyl Carrier Protein Bound to Fabl, the FASII Enoyl Reductase from *Escherichia Coli" J.Biol.Chem. 281*(51): 39285-39293 (2006).
Rawlings et al., "The Gene Encoding *Escherichia coli* Acyl Carrier Protein Lies within a Cluster of Fatty Acid Biosynthetic Genes", *J.Biol.Chem. 267*(9):5751-5754 (1992).
Rawlings et al., "Biosynthesis of fatty acids and related metabolites", *Natural Product Reports 15*: 275-308 (1998).
Ray et al., "Activation of long chain fatty acids with acyl carrier protein: Demonstration of a new enzyme, acyl-acyl carrier protein synthetase, in *Escherichia coli" PNAS 73*(12):4374-4378 (1976).
Rehm et al., "Heterologous expression of the acyl—acyl carrier protein thioesterase gene from the plant *Umbellularia californica* mediates polyhydroxyalkanoate biosynthesis in recombinant *Escherichia coli", Appl. Microbiol. and Biotech. 55*: 205-209 (2001).
Rock et al., "Acyl-Acyl Carrier Protein Synthetase from *Escherichia coli", Meth.Enzymol. 71*: 163-168 (1981).
Rude et al., "Terminal Olefin (1-Alkene) Biosynthesis by a Novel P450 Fatty Acid Decarboxylase from *Jeotgalicoccus* Species", *Appl. Environ.Microbiol. 77*(5): 1718-1727 (2011).
Rude et al., "New microbial fuels: a biotech perspective", *Current Opinion in Microbiology 12*: 274-281 (2009).
Sabirova et al., "Mutation in a "*tesB*-Like" Hydroxyacyl-Coenzyme A-Specific Thioesterase Gene Causes Hyperproduction of Extracellular Polyhydroxyalkanoates by *Alcanivorax borkumensis* SK2", *J. Bacteriol. 188*(23): 8452-8459 (2006).
Saito et al., "Crystal structure of enoyl—acyl carrier protein reductase (FabK) from *Streptococcus neumonia* reveals the binding mode of an inhibitor", *Protein Science 17*: 691-699 ((2008).
Salas et al., "Characterization of substrate specificity of plant FatA and FatB acyl-ACP thioesterases", *Archives of Biochem. And Biophysics 403*: 25-34 (2002).
Sanchez et al., "Effect of Overexpression of a Soluble Pyridine Nucleotide Transhydrogenase (UdhA) on the Production of Poly(3-hydroxybutyrate) in *Escherichia coli", Biotechnol.Prog. 22*: 420-425 (2006).
Schirmer et al., "Microbial Biosynthesis of Alkanes", *Science 329*:559-562 (2010).
Schujman et al., "A malonyl-CoA-dependent switch in the bacterial response to a dysfunction of lipid metabolism", *Molecular Microbiology*, 68(4): 987-996 (2008).
Schweizer et al., "Microbial Type I Fatty Acid Synthases (FAS): Major Players in a Network of Cellular FAS Systems", *Microbiol. Mol.Biol.Rev. 68*(3): 501-517 (2004).
Stöveken et al., "The Wax Ester Synthase/Acyl Coenzyme A:Diacylglycerol Acyltransferase from *Acinetobacter* sp. Strain ADP1: Characterization of a Novel Type of Acyltransferase", *J.Bacteriology 187*(4)1369-1376 (2005).
Subrahmanyam et al., "Overproduction of a Functional Fatty Acid Biosynthetic Enzyme Blocks Fatty Acid Synthesis in *Escherichia coli" J.Bacteriology* 180(17):4596-4602 (1998).
Sulzenbacher et al., "Crystal Structure of *E. coli* Alcohol Dehydrogenase YqhD: Evidence of a Covalently Modified NADP Coenzyme" *J.Mol.Biol. 342*: 489-502 (2004).
Ta et al., "Cloning, Sequencing, and Overexpression oaf [2Fe-2S] Ferredoxin Gene from *Escherichia coil", J.Biol.Chem. 267*(16)11120-11125 (1992).
Thomason et al., "Identification of the *Escherichia coli* K-12 ybhE Gene as pgl, Encoding 6-Phosphogluconolactonase" *J.Bacteriol. 186*(24): 8248-8253 (2004).
Thorpe et al., "Structure and mechanism of action of the Acyl-CoA dehydrogenases1", *FASEB J. 9*: 718-725 (1995).
Tong et al., "Acetyl-Coenzyme a Carboxylases: Versatile Targets for Drug Discovery", *J. Cellular Biochem. 99*: 1476-1488 (2006).
Toomey et al., "Studies on the Mechanism of Fatty Acid Synthesis XVI. Preparation and General Properties of Acyl-Malonyl Acyl Carrier Proteincondensing Enzyme From *Escherichia Coli", J.Biol. Chem. 241*(5):1159-1165 (1996).
Tsay et al., "Isolation and Characterization of the β-Ketoacyl-acyl Carrier Protein Synthase I11 Gene (*fabH*) from *Escherichia coli* K-12", *J.Biol.Chem. 267*(10): 6807-6814 (1992).
UniProt accession No. Q325A2 "Subname: Full=Acyl-CoA thioesterase I" (2005).

Vadali et al., "Cofactor engineering of intracellular CoA/acetyl-CoA and its effect on metabolic flux redistribution in *Escherichia coli" Metabolic Engineering 6*: 133-139 (2004).

Van Den Berg et al., "The FadL family: unusual transporters for unusual substrates", *Curr. Opin.Struct.Biol.* 15: 401-407 (2005).

Voelker et al. "Alteration of the Specificity and Regulation of Fatty Acid Synthesis of *Escherichia coli* by Expression of a Plant Medium-Chain Acyl-Acyl Carrier Protein Thioesterase," *J. Bacteriol.*, 176(23): 7320-7327 (1994).

Wang et al., "Functional Replacement of the FabA and FabB Proteins of *Escherichia coli* Fatty Acid Synthesis by *Enterococcus faecalis* FabZ and FabF Homologues", *J.Biol.Chem.279*(33): 34489-34495 (2004).

White et al., "Carboxylic acid reductase: a new tungsten enzyme catalyzes the reduction of non-activated carboxylic acids to aldehydes", *Eur. J. Biochem. 184*: 89-96 (1989).

Xu et al., "The FadRzDNA Complex. Transcriptional Control of Fatty Acid Metabolism in *Escherichia Coli", J.Biol.Chem.276*(20): 17373-17379, 2001.

Yoo et al., "Determination of the native form of FadD, the *Escherichia coli* fatty acyl-CoA synthetase, and characterization of limited proteolysis by outer membrane protease OmpT", *Biochem. J. 360*: 699-706 (2001).

Zhang et al., "Inhibiting Bacterial Fatty Acid Synthesis", *J.Biol. Chem. 281*(26): 17541-17544 (2006).

Zhang et al., "Structural Basis for Catalytic and Inhibitory Mechanisms of β-Hydroxyacyl-acyl Carrier Protein Dehydratase (FabZ)", *J.Biol.Chem. 283*(9):5370-5379 (2008).

Zhu et al., "Functions of the *Clostridium acetobutylicium* FabF and FabZ proteins in unsaturated fatty acid biosynthesis", *BMC Microbiology 9*:119 (2009).

Zimhony et al., "Characterization of *Mycobacterium smegmatis* Expressing the *Mycobacterium tuberculosis* Fatty Acid Synthase I (*fas1*) Gene", *J.Bacteriol. 186*(13): 4051-4055 (2004).

International Search Report and Written Opinion from PCT/US2007/011923, mailed Feb. 22, 2008.

International Search Report and Written Opinion from PCT/US2010/050026, mailed Jan. 6, 2011.

* cited by examiner

FIG. 2

AAR91681.1

Nucleotide sequence (SEQ ID NO:15)

>gi|40796034:488-4012 Nocardia sp. NRRL 5646 ATP/NADPH-dependent carboxylic acid reductase (car) gene, complete cds ATGGCAGTGGATTCACCGGATGAGCGGCTACAGCGCCGCATTGCACAGTTGTTTGCAGAAGATGAGCAGG
TCAAGGCCGCACGTCCGCTCGAAGCGGTGAGCGCGGCGGTGAGCGCGCCCGGTATGCGGCTGGCGCAGAT
CGCCGCCACTGTTATGGCGGGTTACGCCGACCGCCCGGCCGCCGGGCAGCGTGCGTTCGAACTGAACACC
GACGACGCGACGGGCCGCACCTCGCTGCGGTTACTTCCCCGATTCGAGACCATCACCTATCGCGAACTGT
GGCAGCGAGTCGGCGAGGTTGCCGCGGCCTGGCATCATGATCCCGAGAACCCCTTGCGCGCAGGTGATTT
CGTCGCCCTGCTCGGCTTCACCAGCATCGACTACGCCACCCTCGACCTGGCCGATATCCACCTCGGCGCG
GTTACCGTGCCGTTGCAGGCCAGCGCGGCGGTGTCCCAGCTGATCGCTATCCTCACCGAGACTTCGCCGC
GGCTGCTCGCCTCGACCCCGGAGCACCTCGATGCGGCGGTCGAGTGCCTACTCGCGGGCACCACACCGGA
ACGACTGGTGGTCTTCGACTACCACCCCGAGGACGACGACCAGCGTGCGGCCTTCGAATCCGCCCGCCGC
CGCCTTGCCGACGCGGGCAGCTTGGTGATCGTCGAAACGCTCGATGCCGTGCGTGCCCGGGCCGCGACT
TACCGGCCGCGCCACTGTTCGTTCCCGACACCGACGACGACCCGCTGGCCCTGCTGATCTACACCTCCGG
CAGCACCGGAACGCCGAAGGGCGCGATGTACACCAATCGGTTGGCCGCCACGATGTGGCAGGGGAACTCG
ATGCTGCAGGGGAACTCGCAACGGGTCGGGATCAATCTCAACTACATGCCGATGAGCCACATCGCCGGTC
GCATATCGCTGTTCGGCGTGCTCGCTCGCGGTGGCACCGCATACTTCGCGGCCAAGAGCGACATGTCGAC
ACTGTTCGAAGACATCGGCTTGGTACGTCCCACCGAGATCTTCTTCGTCCCGCGCGTGTGCGACATGGTC
TTCCAGCGCTATCAGAGCGAGCTGGACCGGCGCTCGGTGGCGGGCGCCGACCTGGACACGCTCGATCGGG
AAGTGAAAGCCGACCTCCGGCAGAACTACCTCGGTGGGCGCTTCCTGGTGGCGGTCGTCGGCAGCGCGCC
GCTGGCCGCGGAGATGAAGACGTTCATGGAGTCCGTCCTCGATCTGCCACTGCACGACGGGTACGGGTCG
ACCGAGGCGGGCGCAAGCGTGCTGCTCGACAACCAGATCCAGCGGCCGCCGGTGCTCGATTACAAGCTCG
TCGACGTGCCCGAACTGGGTTACTTCCGCACCGACCGGCCGCATCCGCGCGGTGAGCTGTTGTTGAAGGC
GGAGACCACGATTCCGGGCTACTACAAGCGGCCCGAGGTCACCGCGGAGATCTTCGACGAGGACGGCTTC
TACAAGACCGGCGATATCGTGGCCGAGCTCGAGCACGATCGGCTGGTCTATGTCGACCGTCGCAACAATG
TGCTCAAACTGTCGCAGGGCGAGTTCGTGACCGTCGCCCATCTCGAGGCCGTGTTCGCCAGCAGCCCGCT
GATCCGGCAGATCTTCATCTACGGCAGCAGCGAACGTTCCTATCTGCTCGCGGTGATCGTCCCCACCGAC
GACGCGCTGCGCGGCCGCGACACCGCCACCTTGAAATCGGCACTGGCCGAATCGATTCAGCGCATCGCCA
AGGACGCGAACCTGCAGCCCTACGAGATTCCGCGCGATTTCCTGATCGAGACCGAGCCGTTCACCATCGC
CAACGGACTGCTCTCCGGCATCGCGAAGCTGCTGCGCCCCAATCTGAAGGAACGCTACGGCGCTCAGCTG
GAGCAGATGTACACCGATCTCGCGACAGGCCAGGCCGATGAGCTGCTCGCCCTGCGCCGCGAAGCCGCCG
ACCTGCCGGTGCTCGAAACCGTCAGCCGGGCAGCGAAAGCGATGCTCGGCGTCGCCTCCGCCGATATGCG
TCCCGACGCGCACTTCACCGACCTGGGCGGCGATTCCCTTTCCGCGCTGTCGTTCTCGAACCTGCTGCAC
GAGATCTTCGGGGTCGAGGTGCCGGTGGGTGTCGTCGTCAGCCCGGCGAACGAGCTGCGCGATCTGGCGA
ATTACATTGAGGCGGAACGCAACTCGGGCGCGAAGCGTCCCACCTTCACCTCGGTGCACGGCGGCGGTTC
CGAGATCCGCGCCGCCGATCTGACCCTCGACAAGTTCATCGATGCCCGCACCCTGGCCGCCGCCGACAGC
ATTCCGCACGCGCCGGTGCCAGCGCAGACGGTGCTGCTGACCGGCGCGAACGGCTACCTCGGCCGGTTCC
TGTGCCTGGAATGGCTGGAGCGGCTGGACAAGACGGGTGGCACGCTGATCTGCGTCGTGCGCGGTAGTGA
CGCGGCCGCGGCCCGTAAACGGCTGGACTCGGCGTTCGACAGCGGCGATCCCGGCCTGCTCGAGCACTAC
CAGCAACTGGCCGCACGGACCCTGGAAGTCCTCGCCGGTGATATCGGCGACCCGAATCTCGGTCTGGACG
ACGCGACTTGGCAGCGGTTGGCCGAAACCGTCGACCTGATCGTCCATCCCGCCGCGTTGGTCAACCACGT
CCTTCCCTACACCCAGCTGTTCGGCCCCAATGTCGTCGGCACCGCCGAAATCGTCCGGTTGGCGATCACG
GCGCGGCGCAAGCCGGTCACCTACCTGTCGACCGTCGGAGTGGCCGACCAGGTCGACCCGGCGGAGTATC
AGGAGGACAGCGACGTCCGCGAGATGAGCGCGGTGCGCGTCGTGCGCGAGAGTTACGCCAACGGCTACGG
CAACAGCAAGTGGGCGGGGGAGGTCCTGCTGCGCGAAGCACACGATCTGTGTGGCTTGCCGGTCGCGGTG
TTCCGTTCGGACATGATCCTGGCGCACAGCCGGTACGCGGGTCAGCTCAACGTCCAGGACGTGTTCACCC

FIG. 2 (Cont.)

GGCTGATCCTCAGCCTGGTCGCCACCGGCATCGCGCCGTACTCGTTCTACCGAACCGACGCGGACGGCAA
CCGGCAGCGGGCCCACTATGACGGCTTGCCGGCGGACTTCACGGCGGCGGCGATCACCGCGCTCGGCATC
GAAGCCACCGAAGGCTTCCGGACCTACGACGTGCTCAATCCGTACGACGATGGCATCTCCCTCGATGAAT
TCGTCGACTGGCTCGTCGAATCCGGCCACCCGATCCAGCGCATCACCGACTACAGCGACTGGTTCCACCG
TTTCGAGACGGCGATCCGCGCGCTGCCGGAAAAGCAACGCCAGGCCTCGGTGCTGCCGTTGCTGGACGCC
TACCGCAACCCCTGCCCGGCGGTCCGCGGCGCGATACTCCCGGCCAAGGAGTTCCAAGCGGCGGTGCAAA
CAGCCAAAATCGGTCCGGAACAGGACATCCCGCATTTGTCCGCGCCACTGATCGATAAGTACGTCAGCGA
TCTGGAACTGCTTCAGCTGCTCTGA

Amino acid sequence (SEQ ID NO:16)

>gi|40796035|gb|AAR91681.1| ATP/NADPH-dependent carboxylic acid reductase [Nocardia sp. NRRL 5646]

MAVDSPDERLQRRIAQLFAEDEQVKAARPLEAVSAAVSAPGMRLAQIAATVMAGYADRPAAGQRAFELNT
DDATGRTSLRLLPRFETITYRELWQRVGEVAAAWHHDPENPLRAGDFVALLGFTSIDYATLDLADIHLGA
VTVPLQASAAVSQLIAILTETSPRLLASTPEHLDAAVECLLAGTTPERLVVFDYHPEDDDQRAAFESARR
RLADAGSLVIVETLDAVRARGRDLPAAPLFVPDTDDDPLALLIYTSGSTGTPKGAMYTNRLAATMWQGNS
MLQGNSQRVGINLNYMPMSHIAGRISLFGVLARGGTAYFAAKSDMSTLFEDIGLVRPTEIFFVPRVCDMV
FQRYQSELDRRSVAGADLDTLDREVKADLRQNYLGGRFLVAVVGSAPLAAEMKTFMESVLDLPLHDGYGS
TEAGASVLLDNQIQRPPVLDYKLVDVPELGYFRTDRPHPRGELLLKAETTIPGYYKRPEVTAEIFDEDGF
YKTGDIVAELEHDRLVYVDRRNNVLKLSQGEFVTVAHLEAVFASSPLIRQIFIYGSSERSYLLAVIVPTD
DALRGRDTATLKSALAESIQRIAKDANLQPYEIPRDFLIETEPFTIANGLLSGIAKLLRPNLKERYGAQL
EQMYTDLATGQADELLALRREAADLPVLETVSRAAKAMLGVASADMRPDAHFTDLGGDSLSALSFSNLLH
EIFGVEVPVGVVVSPANELRDLANYIEAERNSGAKRPTFTSVHGGGSEIRAADLTLDKFIDARTLAAADS
IPHAPVPAQTVLLTGANGYLGRFLCLEWLERLDKTGGTLICVVRGSDAAAARKRLDSAFDSGDPGLLEHY
QQLAARTLEVLAGDIGDPNLGLDDATWQRLAETVDLIVHPAALVNHVLPYTQLFGPNVVGTAEIVRLAIT
ARRKPVTYLSTVGVADQVDPAEYQEDSDVREMSAVRVVRESYANGYGNSKWAGEVLLREAHDLCGLPVAV
FRSDMILAHSRYAGQLNVQDVFTRLILSLVATGIAPYSFYRTDADGNRQRAHYDGLPADFTAAAITALGI
QATEGFRTYDVLNPYDDGISLDEFVDWLVESGHPIQRITDYSDWFHRFETAIRALPEKQRQASVLPLLDA
YRNPCPAVRGAILPAKEFQAAVQTAKIGPEQDIPHLSAPLIDKYVSDLELLQLL

FIG. 3

Motif 1

-G-Y-X-X-S/A/T-K-W/L (SEQ ID NO:7); and

-G-X-X-G-X-L-G (SEQ ID NO:8); and

-L/V/I-G-G-D-S-X-X-A (SEQ ID NO:9); and

-[LIVMFY]-{E}-{VES}-[STG]-[STAG]-G-[ST]-[STEIA]-[SG]-X-[PASLIVM]-[KR] (SEQ ID NO:10), where {X} stands for any amino acid except X and [$X_1X_2$] stands for $X_1$ or $X_2$ Motif 2

RTVLLX$_1$GAX$_2$GX$_3$LGRX$_4$LX$_5$LX$_6$WL (SEQ ID NO:11)

where $X_1$ is S or T;

$X_2$ is T or N;

$X_3$ is F or W;

$X_4$ is F or Y;

$X_5$ is A or T; and $X_6$ is E or Q

Motif 3

LXXGXXGXLGXXLXLXWLXR (SEQ ID NO:12)

Motif 4

WAXEVLLR (SEQ ID NO:13), where X can be any amino acid; or

LXXGXXGXLGXXLXX$_1$XX$_2$LX$_3$R (SEQ ID NO:14), where $X_1$ is Leu or Ile;

$X_2$ is Trp or Leu; and $X_3$ varies between 13 amino acids or 14 amino acids

Motif 5

-G-Y-X-X-S/A/T-K-W/L (SEQ ID NO:7); and

-L/V/I-G-G-D-S-X-X-A (SEQ ID NO:9); and

FIG. 3 (Cont.)

-[LIVMFY]-{E}-{VES}-[STG]-[STAG]-G-[ST]-[STEIA]-[SG]-X-[PASLIVM]-[KR] (SEQ ID NO:10), where {X} stands for any amino acid except X and [$X_1X_2$] stands for $X_1$ or $X_2$; and RTVLL$X_1$GA$X_2$G$X_3$LGR$X_4$L$X_5$L$X_6$WL (SEQ ID NO:11), where $X_1$ is S or T;

$X_2$ is T or N;

$X_3$ is F or W;

$X_4$ is F or Y;

$X_5$ is A or T; and $X_6$ is E or Q

FIG. 4

NP 217106 (FADD9)

Nucleotide sequence (SEQ ID NO:17)

>gi|57116681:2917871-2921377 Mycobacterium tuberculosis H37Rv, complete genome

ATGTCGATCAACGATCAGCGACTGACACGCCGCGTCGAGGACCTATACGCCAGCGACGCCCAGTTCGCCG
CCGCCAGTCCCAACGAGGCGATCACCCAGGCGATCGACCAGCCCGGGGTCGCGCTTCCACAGCTCATCCG
TATGGTCATGGAGGGCTACGCCGATCGGCCGGCACTCGGCCAGCGTGCGCTCCGCTTCGTCACCGACCCC
GACAGCGGCCGCACCATGGTCGAGCTACTGCCGCGGTTCGAGACCATCACCTACCGCGAACTGTGGGCCC
GCGCCGGCACATTGGCCACCGCGTTGAGCGCTGAGCCCGCGATCCGGCCGGGCGACCGGGTTTGCGTGCT
GGGCTTCAACAGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACGATGATCGCCA
CCAGCATCGACAATCTTGGCGACGCCGTCGAAGTGCTGGCCGGTCACGCCCCGGCCCGGCTGGTCGTATT
CGATTACCACGGCAAGGTTGACACCCACCGCGAGGCCGTCGAAGCCGCCCGAGCTCGGTTGGCCGGCTCG
GTGACCATCGACACACTTGCCGAACTGATCGAACGCGGCAGGGCGCTGCCGGCCACACCCATTGCCGACA
GCGCCGACGACGCGCTGGCGCTGCTGATTTACACCTCGGGTAGTACCGGCGCACCCAAAGGCGCCATGTA
TCGCGAGAGCCAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACGCTTTCCAACG
GCGGTACCGCCTACTTCGTCGCCAAGAGCGACCTGTCGACGCTGTTCGAGGACCTCGCCCTGGTGCGGCC
CACAGAATTGTGCTTCGTGCCGCGCATCTGGGACATGGTGTTCGCAGAGTTCCACAGCGAGGTCGACCGC
CGCTTGGTGGACGGCGCCGATCGAGCGGCGCTGGAAGCGCAGGTGAAGGCCGAGCTGCGGGAGAACGTGC
TCGGCGGACGGTTTGTCATGGCGCTGACCGGTTCCGCGCCGATCTCCGCTGAGATGACGGCGTGGGTCGA
GTCCCTGCTGGCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGCTACTTCGGCA
CCGATCAGCCCTACCCCCGGGGCGAGCTGCTGGTCAAGACGCAAACCATGTTCCCCGGCTACTACCAGCG
CCCGGATGTCACCGCCGAGGTGTTCGACCCCGACGGCTTCTACCGGACCGGGGACATCATGGCCAAAGTA
GGCCCCGACCAGTTCGTCTACCTCGACCGCCGCAACAACGTGCTAAAGCTCTCCCAGGGCGAGTTCATCG
CCGTGTCGAAGCTCGAGGCGGTGTTCGGCGACAGCCCGCTGGTCCGACAGATCTTCATCTACGGCAACAG
TGCCCGGGCCTACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCCTACGAGATTC
CACGCGACTTCATCATCGAAACCACGCCGTTCACCCTGGAGAACGGCCTGCTCACCGGCATCCGCAAGCT
GGCACGCCCGCAGTTGAAGAAGTTCTATGGCGAACGTCTCGAGCGGCTCTATACCGAGCTGGCCGATAGC
CAATCCAACGAGCTGCGCGAGCTGCGGCAAAGCGGTCCCGATGCGCCGGTGCTTCCGACGCTGTGCCGTG
CCGCGGCTGCGTTGCTGGGCTCTACCGCTGCGGATGTGCGGCCGGACGCGCACTTCGCCGACCTGGGTGG
TGACTCGCTCTCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGCACCGGCGTCA
GGCGACCCAGCTTCGCCTCGATACACGGTCGCTCCGCGACGGAAGTGCACGCCAGCGACCTCACGCTGGA
CAAGTTCATCGACGCTGCCACCCTGGCCGCAGCCCCGAACCTGCCGGCACCGAGCGCCCAAGTGCGCACC
GTACTGCTGACCGGCGCCACCGGCTTTTTGGGTCGCTACCTGGCGCTGGAATGGCTCGACCGCATGGACC
TGGTCAACGGCAAGCTGATCTGCCTGGTCCGCGCCAGATCCGACGAGGAAGCACAAGCCCGGCTGGACGC
GACGTTCGATAGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTAGCCGACACGG
TGGACCTGATCGTGGACCCCGCGGCCCTGGTCAACCACGTGCTGCCGTATAGCCAGCTGTTCGGCCCAAA
CGCGGCGGGCACCGCCGAGTTGCTTCGGCTGGCGCTGACCGGCAAGCGCAAGCCATACATCTACACCTCG
ACGATCGCCGTGGGCGAGCAGATCCCGCCGGAGGCGTTCACCGAGGACGCCGACATCCGGGCCATCAGCC
CGACCCGCAGGATCGACGACAGCTACGCCAACGGCTACGCGAACAGCAAGTGGGCCGGCGAGGTGCTGCT
GCGCGAAGCTCACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCCGCTACCGGCA

FIG. 4 (Cont.)

TCGCACCCGGTTCGTTCTATGAGCTGGATGCGCACGGCAATCGGCAACGCGCCCACTATGACGGCTTGCC
GGTCGAATTCGTCGCAGAAGCCATTTGCACCCTTGGGACACATAGCCCGGACCGTTTTGTCACCTACCAC
GTGATGAACCCCTACGACGACGGCATCGGGCTGGACGAGTTCGTCGACTGGCTCAACTCCCCAACTAGCG
GGTCCGGTTGCACGATCCAGCGGATCGCCGACTACGGCGAGTGGCTGCAGCGGTTCGAGACTTCGCTGCG
TGCCTTGCCGGATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAAATCGGTCCGG
ACAAAGACATTCCGCACCTCACGGCGGCGATCATCGCGAAGTACATCAGCAACCTGCGACTGCTCGGGCT
GCTGTGA

Amino acid sequence (SEQ ID NO:18)

>gi|15609727|ref|NP_217106.1| fatty-acid-CoA ligase [Mycobacterium tuberculosis H37Rv]

MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLIYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILADT
SYTGQLNLPDMFTRLMLSLAATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALPDRQRHASLLPLLHNYREPAK
PICGSIAPTDQFRAAVQEAKIGPDKDIPHLTAAIIAKYISNLRLLGLL

ABK75684 (CARA)

Nucleotide sequence (SEQ ID NO:19)

>gi|118168627:3015785-3019291 Mycobacterium smegmatis str. MC2 155, complete genome TTACAGCAATCCGAGCATCTGCAGGTTGCTGATGTACTTGACGATCACGTCGGCCGTGACGTGCGGAATG
TCCTTGTCGGGGCCGATCTTCGCGTCCTGCACCGCGGCACGGAACCGGTCGGTGGGTGCCATGGCACCGC
ACACGGGCGGTGAGGGCTGCTGATAGTTGTGCAGCAGCGGCAGCAGCGAGGCCTGACGTTGCCGTTCCGG
CAGGGCCCGCAGTGCGGTTTCGAACCGGCTCAGCCAGGTGGCGTAGTCGTCGACGCGGTGCACGGGGTAG
CCGGCCTCGATCAGCCAGTCCACGTACTCGTCGAGGCCGATGCCGTCGTCGTACGGGTTCATCACGTGGA
ACGTCTCGAATCCGTCGGTGACCTGCGAGCCGATGGTGGAGATCGCCTCGGCGATGAACTCCACGGGCAG
CCCGTCGTAGTGGGCGCGCTGCCGGTTGCCGTCCGCATCGAGTTCGTAGAACGAACCGGGCGCGATGCCG
GTCGCCACGAGGCTCAGCATCAGGCGGGTGAACATGTCCGGCAGGTTCAGCTGACCCGAGTAGGTCGTGT
CGGCCAGGATCATGTCGCAGCGGAACACCGAGACCGGCAGACCACACCAGTCGTGCGCCTCCCGCAGCAG
GACCTCGCCGGCCCACTTGCTGTTGCCGTAGCCGTTGGCGTACGAGTCGTCGACCCGGCGCGTCGCGCTG
ATCTCGCGGATGTCGGCGTCCTCGACGAACGCCTCGGGGGAGATGCCCTGTCCCACACCGATCGTCGAGA
CGTACACGTACGGCTTGATCGTGGTGGTCAGCGCGATCCGGATGAGTTCGGCGGTGCCGAGCGCATTGGG

FIG. 4 (Cont.)

TCCGAACATCTGGCTGTACGGCAGGACGTGATTGACCAGGGCGGCCGGATCGACGATCAGATCGACGGTG
TCGGCCAGTCGCTGCCACGTGTCGTGGTCGAGACCCAGATCGGCCTCGCCCTTGTCACCGGCGATCACCT
CGAGGTGATCGGCTGCCAGCGCGCGGTAGTGCTCGAGCAGTGTCGCGTCCCCGGTGTCGAACGTGGCGTC
CAGACGCGCCCGGGCCTCGTCGTCGCTGCGGGCGCGCACCAGGCAGATCACCTTGCCGTCCACCAGGTCC
ATGCGCTCCAGCCATTCCAGCGCCAGATAGCGGCCCAGGAACCCGGTGGCGCCGGTCAGCAGCACGGTGC
GGATCTCGGTGCCCGAACGCGGCAGACCCGGCGCGGCGGACAGGGTCTTGGCGTCGATGAACTTGCCCAG
GGCGAGATCACGCGCGCGCACCTCGGTGGCGTCGCGCCCGTGCACCGACGCGTATGTGGGGCGCTTGGAG
CCGCGCAGTTCGCCCTCGATGTAGGCCGCGACGCCTGCCAGGTCGGTGGCCGGGCTGACGATGACGCCGA
CCGGCACGTCGACATCGAAGATCTCGTGCAACAGGTTCGAGAAGCTCAAGGCCGACAACGAATCTCCACC
CAGATCGGTGAAGTGCGCATCGGACCGCAGATCCGTGACGGAGGCACCGAGCAGTGCGACCGCGGCGCGG
CTGACGGTCTCGACCACGGGCCGGTCGGCTCCGTTGCGGCGCAACTCGCGCAACTCGTTGGCCTGCCCCT
CGGCCAGGTCGGTGTAGAGCTGTTCGAGGCGTTCGCCGTAGTGCGCCTTCAGTTTCGGCCGGGCCAGCTT
GCGGATACCGGTCAGCAGGCCGTTCTCCAGCGTGAAAGGTGTTGTCTCGACGAGGAAGTCACGCGGGATC
TCATACGACTGCAATCCGGCGGCTCGTGCCGCGTCCTGCAGTGAGTCGCTGATGCGCGACTTGAGTTCGT
CACCGTCCCAACGTGACAGTGCCTCTTCGGTCGGGACCACGACCGCCAGCAGATAGGACCGCGCGCTGTT
GCCGTAGACGTAGATCTGGCGTACCAGGGGGCTGTCGCCGAACACCGCCTCCAGCTTGGAGACCGTGACG
AATTCGCCCTGCGACAGTTTCAGCACGTTGTTGCGGCGGTCGAGGTATTCGAGATGGTCGGGCCCGAGCT
CGGCGACGATGTCGCCGGTGCGGTAGTACCCGTCCTCGTCGAACATCTCGGCGGTGATCTCCGGACGCTT
GTAGTAGCCGGGGAACATCTGCTCGGACTTGACCAGAAGTTCGCCGCGCGGGTAGGGCCGGTCCGTGGCG
AAGTAGCCGAGATCGGGCACGTCGACCAGCTTGTAGTCGATGACCGGCGGGCGCTGGATCTGCCCGTCGA
TGAACACCGCGCCGGCCTCGGTGGAGCCGTAGCCCTCCAGCAGATGCATGTCGAGCAGGTCCTCGACCCA
GCTCTTCATCTCCGCCGAGATGGGAGCCGATCCGGTCAGGGCCGAAACGAATCGCCCGCCGAGCAGTTGG
GTGCGGACCTCTTCGAGGACTGCGGCTTCGGCTCGGTCCTCGGATCCCTCGGCGCGGCGGTTGTCGAGGC
GGCTCTGGTACTCCTGGAACAGCATGTCCCAGATGCGAGGAACGAAGTTGAGCTGCGTGGGCCGCACGAG
GGCGAGGTCCTCCAGGAAGGTGGACAGGTCGCTGCGTGCGGCGAAGTACGCGGTTCCGCCGCTGGCGAGT
GTGCTGCACAGGATGCCGCGCCCCATGACGTGACTCATGGGCATGAAGTTCAGGGTGATCGACGGCATCA
CGCCGAGGGTCTCGTCCCACCGGGCCTTGGACCCGGCCTGCCACATCGTGGCGGTCTTGGACTCGGGGTA
CATCGCGCCCTTGGGAGTGCCGGTGCTGCCGGAGGTGTAGATGAGAAGGGTCAGCGGGTCGGCCTCGTCG
GGCACGTAGAGCGGTGCGTCGGCGAGTGACCGCCCGCGGTCCAGTGCGTCGGTGATCGTCTCGACGACGA
CGCCGGTGCCTGCGAGCTTGCCCTTGGCCGCCTCGAACGCCTCACGCTGATCGTCGACCTCGTGGCTGTA
GTCGAACACCACCAGTCGCGACGGCGCGGGCCCGGACTCGACGAGAGCGACTGCGTCGGCGAGGAAGTCG
ACGCTCGACGCGATCACCTTGGGCTCGGTCTCGGCGACGATCGGCTGCAGTTGGGCCACCGGCGCACTGG
TCTGCAGCGGTACGGACACGGCGCCGAGTTCGAGCAGGGCGATGTCGATCGTCGTGTAGTCGACACTGGT
GAAACCCAGGATGGCCACGCGGTCACCGGCATTCACCGGATGGTTGTGCCAGGCATTGGTCACGGCCTGG
ATCCGGCCTGCGAGCTGACGGTAGGTGATGGTGTCGAAGCGGGGCAGGAGCTTCGCGGTGGTGCGGCCTT
CTTCGTCGGTGACGAACTCGACGGCGCGCTTGCCCAGCGCAGGGCGGTCCGCATAGCCGGCCAGAATCTG
TTTGACCGCGGCAGGAAGGCGCAACTCCGGATCGGCGGCAGCCGCGCTGATCGCCTCGTCGGGACGGGCG
GCGGCGAACTGCGGGTCGGTTTCGAACAAGTGGTCAATGCGCCGGTTGAAGCGGTCTTCGCGCGTTTCGA
TCGTCAT

Amino acid sequence (SEQ ID NO:20)

>gi|118174788|gb|ABK75684.1| NAD dependent epimerase/dehydratase family protein [Mycobacterium smegmatis str. MC2 155]

MTIETREDRFNRRIDHLFETDPQFAAARPDEAISAAAADPELRLPAAVKQILAGYADRPALGKRAVEFVT
DEEGRTTAKLLPRFDTITYRQLAGRIQAVTNAWHNHPVNAGDRVAILGFTSVDYTTIDIALLELGAVSVP
LQTSAPVAQLQPIVAETEPKVIASSVDFLADAVALVESGPAPSRLVVFDYSHEVDDQREAFEAAKGKLAG
TGVVVETITDALDRGRSLADAPLYVPDEADPLTLLIYTSGSTGTPKGAMYPESKTATMWQAGSKARWDET
LGVMPSITLNFMPMSHVMGRGILCSTLASGGTAYFAARSDLSTFLEDLALVRPTQLNFVPRIWDMLFQEY
QSRLDNRRAEGSEDRAEAAVLEEVRTQLLGGRFVSALTGSAPISAEMKSWVEDLLDMHLLEGYGSTEAGA
VFIDGQIQRPPVIDYKLVDVPDLGYFATDRPYPRGELLVKSEQMFPGYYKRPEITAEMFDEDGYYRTGDI

FIG. 4 (Cont.)

VAELGPDHLEYLDRRNNVLKLSQGEFVTVSKLEAVFGDSPLVRQIYVYGNSARSYLLAVVVPTEEALSRW
DGDELKSRISDSLQDAARAAGLQSYEIPRDFLVETTPFTLENGLLTGIRKLARPKLKAHYGERLEQLYTD
LAEGQANELRELRRNGADRPVVETVSRAAVALLGASVTDLRSDAHFTDLGGDSLSALSFSNLLHEIFDVD
VPVGVIVSPATDLAGVAAYIEGELRGSKRPTYASVHGRDATEVRARDLALGKFIDAKTLSAAPGLPRSGT
EIRTVLLTGATGFLGRYLALEWLERMDLVDGKVICLVRARSDDEARARLDATFDTGDATLLEHYRALAAD
HLEVIAGDKGEADLGLDHDTWQRLADTVDLIVDPAALVNHVLPYSQMFGPNALGTAELIRIALTTTIKPY
VYVSTIGVGQGISPEAFVEDADIREISATRRVDDSYANGYGNSKWAGEVLLREAHDWCGLPVSVFRCDMI
LADTTYSGQLNLPDMFTRLMLSLVATGIAPGSFYELDADGNRQRAHYDGLPVEFIAEAISTIGSQVTDGF
ETFHVMNPYDDGIGLDEYVDWLIEAGYPVHRVDDYATWLSRFETALRALPERQRQASLLPLLHNYQQPSP
PVCGAMAPTDRFRAAVQDAKIGPDKDIPHVTADVIVKYISNLQMLGLL

YP 889972 (CARB)

Nucleotide sequence (SEQ ID NO:21)

>gi|118467340:5821317-5824838 Mycobacterium smegmatis str. MC2 155, complete genome ATGACCAGCGATGTTCACGACGCCACAGACGGCGTCACCGAAACCGCACTCGACGACGAGCAGTCGACCC
GCCGCATCGCCGAGCTGTACGCCACCGATCCCGAGTTCGCCGCCGCCGCACCGTTGCCCGCCGTGGTCGA
CGCGGCGCACAAACCCGGGCTGCGGCTGGCAGAGATCCTGCAGACCCTGTTCACCGGCTACGGTGACCGC
CCGGCGCTGGGATACCGCGCCCGTGAACTGGCCACCGACGAGGGCGGGCGCACCGTGACGCGTCTGCTGC
CGCGGTTCGACACCCTCACCTACGCCCAGGTGTGGTCGCGCGTGCAAGCGGTCGCCGCGGCCCTGCGCCA
CAACTTCGCGCAGCCGATCTACCCCGGCGACGCCGTCGCGACGATCGGTTTCGCGAGTCCCGATTACCTG
ACGCTGGATCTCGTATGCGCCTACCTGGGCCTCGTGAGTGTTCCGCTGCAGCACAACGCACCGGTCAGCC
GGCTCGCCCCGATCCTGGCCGAGGTCGAACCGCGGATCCTCACCGTGAGCGCCGAATACCTCGACCTCGC
AGTCGAATCCGTGCGGGACGTCAACTCGGTGTCGCAGCTCGTGGTGTTCGACCATCACCCCGAGGTCGAC
GACCACCGCGACGCACTGGCCCGCGCGCGTGAACAACTCGCCGGCAAGGGCATCGCCGTCACCACCCTGG
ACGCGATCGCCGACGAGGGCGCCGGGCTGCCGGCCGAACCGATCTACACCGCCGACCATGATCAGCGCCT
CGCGATGATCCTGTACACCTCGGGTTCCACCGGCGCACCCAAGGGTGCGATGTACACCGAGGCGATGGTG
GCGCGGCTGTGGACCATGTCGTTCATCACGGGTGACCCCACGCCGGTCATCAACGTCAACTTCATGCCGC
TCAACCACCTGGGCGGGCGCATCCCCATTTCCACCGCCGTGCAGAACGGTGGAACCAGTTACTTCGTACC
GGAATCCGACATGTCCACGCTGTTCGAGGATCTCGCGCTGGTGCGCCCGACCGAACTCGGCCTGGTTCCG
CGCGTCGCCGACATGCTCTACCAGCACCACCTCGCCACCGTCGACCGCCTGGTCACGCAGGGCGCCGACG
AACTGACCGCCGAGAAGCAGGCCGGTGCCGAACTGCGTGAGCAGGTGCTCGGCGGACGCGTGATCACCGG
ATTCGTCAGCACCGCACCGCTGGCCGCGGAGATGAGGGCGTTCCTCGACATCACCCTGGGCGCACACATC
GTCGACGGCTACGGGCTCACCGAGACCGGCGCCGTGACACGCGACGGTGTGATCGTGCGGCCACCGGTGA
TCGACTACAAGCTGATCGACGTTCCCGAACTCGGCTACTTCAGCACCGACAAGCCCTACCCGCGTGGCGA
ACTGCTGGTCAGGTCGCAAACGCTGACTCCCGGGTACTACAAGCGCCCCGAGGTCACCGCGAGCGTCTTC
GACCGGGACGGCTACTACCACACCGGCGACGTCATGGCCGAGACCGCACCCGACCACCTGGTGTACGTGG
ACCGTCGCAACAACGTCCTCAAACTCGCGCAGGGCGAGTTCGTGGCGGTCGCCAACCTGGAGGCGGTGTT
CTCCGGCGCGGCGCTGGTGCGCCAGATCTTCGTGTACGGCAACAGCGAGCGCAGTTTCCTTCTGGCCGTG
GTGGTCCCGACGCCGGAGGCGCTCGAGCAGTACGATCCGGCCGCGCTCAAGGCCGCGCTGGCCGACTCGC
TGCAGCGCACCGCACGCGACGCCGAACTGCAATCCTACGAGGTGCCGGCCGATTTCATCGTCGAGACCGA
GCCGTTCAGCGCCGCCAACGGGCTGCTGTCGGGTGTCGGAAAACTGCTGCGGCCCAACCTCAAAGACCGC
TACGGGCAGCGCCTGGAGCAGATGTACGCCGATATCGCGGCCACGCAGGCCAACCAGTTGCGCGAACTGC
GGCGCGCGGCCGCCACACAACCGGTGATCGACACCCTCACCCAGGCCGCTGCCACGATCCTCGGCACCGG
GAGCGAGGTGGCATCCGACGCCCACTTCACCGACCTGGGCGGGGATTCCCTGTCGGCGCTGACACTTTCG
AACCTGCTGAGCGATTTCTTCGGTTTCGAAGTTCCCGTCGGCACCATCGTGAACCCGGCCACCAACCTCG
CCCAACTCGCCCAGCACATCGAGGCGCAGCGCACCGCGGGTGACCGCAGGCCGAGTTTCACCACCGTGCA
CGGCGCGGACGCCACCGAGATCCGGGCGAGTGAGCTGACCCTGGACAAGTTCATCGACGCCGAAACGCTC
CGGGCCGCACCGGGTCTGCCCAAGGTCACCACCGAGCCACGGACGGTGTTGCTCTCGGGCGCCAACGGCT
GGCTGGGCCGGTTCCTCACGTTGCAGTGGCTGGAACGCCTGGCACCTGTCGGCGGCACCCTCATCACGAT

FIG. 4 (Cont.)

CGTGCGGGGCCGCGACGACGCCGCGGCCCGCGCACGGCTGACCCAGGCCTACGACACCGATCCCGAGTTG
TCCCGCCGCTTCGCCGAGCTGGCCGACCGCCACCTGCGGGTGGTCGCCGGTGACATCGGCGACCCGAATC
TGGGCCTCACACCCGAGATCTGGCACCGGCTCGCCGCCGAGGTCGACCTGGTGGTGCATCCGGCAGCGCT
GGTCAACCACGTGCTCCCCTACCGGCAGCTGTTCGGCCCCAACGTCGTGGGCACGGCCGAGGTGATCAAG
CTGGCCCTCACCGAACGGATCAAGCCCGTCACGTACCTGTCCACCGTGTCGGTGGCCATGGGGATCCCCG
ACTTCGAGGAGGACGGCGACATCCGGACCGTGAGCCCGGTGCGCCCGCTCGACGGCGGATACGCCAACGG
CTACGGCAACAGCAAGTGGGCCGGCGAGGTGCTGCTGCGGGAGGCCCACGATCTGTGCGGGCTGCCCGTG
GCGACGTTCCGCTCGGACATGATCCTGGCGCATCCGCGCTACCGCGGTCAGGTCAACGTGCCAGACATGT
TCACGCGACTCCTGTTGAGCCTCTTGATCACCGGCGTCGCGCCGCGGTCGTTCTACATCGGAGACGGTGA
GCGCCCGCGGGCGCACTACCCCGGCCTGACGGTCGATTTCGTGGCCGAGGCGGTCACGACGCTCGGCGCG
CAGCAGCGCGAGGGATACGTGTCCTACGACGTGATGAACCCGCACGACGACGGGATCTCCCTGGATGTGT
TCGTGGACTGGCTGATCCGGGCGGGCCATCCGATCGACCGGGTCGACGACTACGACGACTGGGTGCGTCG
GTTCGAGACCGCGTTGACCGCGCTTCCCGAGAAGCGCCGCGCACAGACCGTACTGCCGCTGCTGCACGCG
TTCCGCGCTCCGCAGGCACCGTTGCGCGGCGCACCCGAACCCACGGAGGTGTTCCACGCCGCGGTGCGCA
CCGCGAAGGTGGGCCCGGGAGACATCCCGCACCTCGACGAGGCGCTGATCGACAAGTACATACGCGATCT
GCGTGAGTTCGGTCTGATCTGA

Amino acid sequence (SEQ ID NO:22)

>gi|118469671|ref|YP_889972.1| putative long-chain fatty-acid--CoA ligase [Mycobacterium smegmatis str. MC2 155]

MTSDVHDATDGVTETALDDEQSTRRIAELYATDPEFAAAAPLPAVVDAAHKPGLRLAEILQTLFTGYGDR
PALGYRARELATDEGGRTVTRLLPRFDTLTYAQVWSRVQAVAAALRHNFAQPIYPGDAVATIGFASPDYL
TLDLVCAYLGLVSVPLQHNAPVSRLAPILAEVEPRILTVSAEYLDLAVESVRDVNSVSQLVVFDHHPEVD
DHRDALARAREQLAGKGIAVTTLDAIADEGAGLPAEPIYTADHDQRLAMILYTSGSTGAPKGAMYTEAMV
ARLWTMSFITGDPTPVINVNFMPLNHLGGRIPISTAVQNGGTSYFVPESDMSTLFEDLALVRPTELGLVP
RVADMLYQHHLATVDRLVTQGADELTAEKQAGAELREQVLGGRVITGFVSTAPLAAEMRAFLDITLGAHI
VDGYGLTETGAVTRDGVIVRPPVIDYKLIDVPELGYFSTDKPYPRGELLVRSQTLTPGYYKRPEVTASVF
DRDGYYHTGDVMAETAPDHLVYVDRRNNVLKLAQGEFVAVANLEAVFSGAALVRQIFVYGNSERSFLLAV
VVPTPEALEQYDPAALKAALADSLQRTARDAELQSYEVPADFIVETEPFSAANGLLSGVGKLLRPNLKDR
YGQRLEQMYADIAATQANQLRELRRAAATQPVIDTLTQAAATILGTGSEVASDAHFTDLGGDSLSALTLS
NLLSDFFGFEVPVGTIVNPATNLAQLAQHIEAQRTAGDRRPSFTTVHGADATEIRASELTLDKFIDAETL
RAAPGLPKVTTEPRTVLLSGANGWLGRFLTLQWLERLAPVGGTLITIVRGRDDAAARARLTQAYDTDPEL
SRRFAELADRHLRVVAGDIGDPNLGLTPEIWHRLAAEVDLVVHPAALVNHVLPYRQLFGPNVVGTAEVIK
LALTERIKPVTYLSTVSVAMGIPDFEEDGDIRTVSPVRPLDGGYANGYGNSKWAGEVLLREAHDLCGLPV
ATFRSDMILAHPRYRGQVNVPDMFTRLLLSLLITGVAPRSFYIGDGERPRAHYPGLTVDFVAEAVTTLGA
QQREGYVSYDVMNPHDDGISLDVFVDWLIRAGHPIDRVDDYDDWVRRFETALTALPEKRRAQTVLPLLHA
FRAPQAPLRGAPEPTEVFHAAVRTAKVGPGDIPHLDEALIDKYIRDLREFGLI

<u>YP 905678.1</u>

Nucleotide sequence (SEQ ID NO:23)

>uniprot|A0PPD8|A0PPD8_MYCUA Fatty-acid-CoA ligase FadD9

ATGTCGCCAATCACGCGTGAAGAGCGGCTCGAGCGCCGCATCCAGGACCTCTACGCCAAC
GACCCGCAGTTCGCCGCCGCCAAACCCGTCACGGCGATCACCGCAGCAATCGAGCGGCCG
GGTCTACCGCTACCCCAGATCATCGAGACCGTCATGACCGGATACGCCGATCGGCCGGCT
CTCGCTCAGCGCTCGGTCGAATTCGTGACCGATGCCGGCACCGGCCACACCACGCTGCGA
CTGCTCCCCCACTTCGAAACCATCAGCTACGGCGAGCTTTGGGACCGCATCAGCGCACTG

FIG. 4 (Cont.)

GCCGACGTGCTCAGCACCGAACAGACGGTGAAACCGAGCGACCGGGTCTGCTTGTTGGGC
TTCAACAGCGTCGACTACGCCACGATCGACATGACTTTGGCGCGGCTGGGCGCGGTGGCT
GTACCACTGCAGACCAGCGCGGCGATAACCCAGCTGCAGCCGATCGTCGCCGAGACCCAG
CCCACCATGATCGCGGCCAGCGTCGACGCACTCGCTGACGCCACCGAATTGGCTCTGTCC
GGTCAGACCGCTACCCGAGTCCTGGTGTTCGACCACCACCGGCAGGTTGACGCACACCGC
GCAGCGGTCGAATCCGCCCGGGAGCGCCTGGCTGGCTCGGCGGTCGTCGAAACCCTGGCC
GAGGCCATCGCGCGCGGCGACGTGCCCCGCGGTGCGTCCGCCGGCTCGGCGCCCGGCACC
GATGTGTCCGACGACTCGCTCGCGCTACTGATCTACACCTCGGGCAGCACCGGTGCGCCC
AAGGGCGCGATGTACCCCCGACGCAACGTTGCGACCTTCTGGCGCAAGCGCACCTGGTTC
GAAGGCGGCTACGAGCCGTCGATCACGCTGAACTTCATGCCAATGAGCCACGTCATGGGC
CGCCAAATCCTGTACGGCACGCTGTGCAATGGCGGCACCGCCTACTTCGTGGTGAAAAGC
GATCTCTCCACCTTGTTCGAAGACCTGGCGCTGGTGCGGCCCACCGAGCTGACCTTCGTG
CCGCGCGTGTGGGACATGGTGTTCGACGAGTTTCAGAGTGAGGTCGACCGCCGCCTGGTC
GACGGCGCCGACCGGGTCGCGCTCGAAGCCCAGGTCAAGGCCGAGATACGCAACGACGTG
CTCGGTGGACGGTATACCAGCGCACTGACCGGCTCCGCCCCGATCTCCGACGAGATGAAG
GCGTGGGTCGAGGAGCTGCTCGACATGCATCTGGTCGAGGGCTACGGCTCCACCGAGGCC
GGGATGATCCTGATCGACGGAGCCATTCGGCGCCCGGCGGTACTCGACTACAAGCTGGTC
GATGTTCCCGACCTGGGTTACTTCCTGACCGACCGGCCACATCCGCGGGGCGAGTTGCTG
GTCAAGACCGATAGTTTGTTCCCGGGCTACTACCAGCGAGCCGAAGTCACCGCCGACGTG
TTCGATGCTGACGGCTTCTACCGGACCGGCGACATCATGGCCGAGGTCGGCCCCGAACAG
TTCGTGTACCTCGACCGCCGCAACAACGTGTTGAAGCTGTCGCAGGGCGAGTTCGTCACC
GTCTCCAAACTCGAAGCGGTGTTTGGCGACAGCCCACTGGTACGGCAGATCTACATCTAC
GGCAACAGCGCCCGTGCCTACCTGTTGGCGGTGATCGTCCCCACCCAGGAGGCGCTGGAC
GCCGTGCCTGTCGAGGAGCTCAAGGCGCGGCTGGGCGACTCGCTGCAAGAGGTCGCAAAG
GCCGCCGGCCTGCAGTCCTACGAGATCCCGCGCGACTTCATCATCGAAACAACACCATGG
ACGCTGCAGAACGGCCTGCTCACCGGCATCCGCAAGTTGGCCAGGCCGCAGCTGAAAAAG
CATTACGGCGAGCTTCTCGAGCAGATCTACACGGACCTGGCACACGGCCAGGCCGACGAA
CTGCGCTCGCTGCGCCAAAGCGGTGCCGATGCGCCGGTGCTGGTGACGGTGTGCCGCGCG
GCGGCCGCGCTGTTGGGCGGCAGCGCCTCTGACGTCCAGCCCGATGCGCACTTCACCGAT
TTGGGCGGCGACTCGCTGTCGGCGCTGTCGTTCACCAACCTGCTGCACGAGATCTTCGAC
ATCGATGTGCCGGTGGGCGTCATCGTCAGCCCCGCCAACGACTTGCAGGCCCTGGCCGAC
TACGTCGAGGCGGCTCGCAAACCCGGCTCGTCACGACCGACCTTCGCCTCGGTCCACGGC
GCCTCGAATGAGCAGGTCACCGAGGTGCATGCCGGTGACCTGTCCCTGGACAAATTCATC
GATGCCGCAACCCTGGCCGAAGCTCCCCGGCTGCCCGCCGCAAACACCCAAGTGCGCACC
GTGCTGCTGACCGGCGCCACCGGCTTCCTCGGGCGCTACCTGGCCCTGGAATGGCTGGAG
CGGATGGACCTGGTCGACGGCAAACTGATCTGCCTGGTCCGGGCCAAGTCCGACACCGAA
GCACGGGCGCGGCTGGAAAAGACGTTCGACAGCGGCGCCCCCGAACTGCTGGCCCACTAC
CGCGCACTGGCCGGCGACCACCTCGAGGTGCTCGCCGGTGACAAGGGCGAAGCCGACCTC
GGACTGGACCGGCAGACCTGGCAACGCCTGGCCGACACGGTCGACCTGATCGTGGACCCC
GCGGCCCTGGTCAACCACGTACTGCCATACAGCCAGCTGTTCGGGCCCAACGCGCTGGGC
ACCGCCGAGCTGCTGCGGCTCGCGCTCACCTCCAAGATCAAGCCCTACAGCTACACCTCG
ACAATCGGTGTCGCCGACCAGATCCCGCCGTCGGCGTTCACCGAGGACGCCGACATCCGG
GTCATCAGCGCCACCCGCGCGGTCGACGACAGCTACGCCAATGGCTATTCGAACAGCAAG
TGGGCCGGCGAGGTGCTGTTGCGCGAGGCGCATGTCCTGTGTGGCCTGCCGGTTGCGGTG
TTCCGCTGCGACATGATCCTGGCCGACACCACATGGGCGGGACAGCTCAACGTGCCGGAC
ATGTTCACCCGTATGATCCTGAGCCTGGCGGCCACCGGTATCGCGCCGGGTTCGTTCTAT
GAGCTTGCGGCCGACGGCGCCCGGCAACGCGCCCACTATGACGGTCTGCCCGTCGAGTTC
ATCGCCGAGGCGATTTCGACTTTGGGTGCGCAGAGCCAGGATGGGTTCCACACGTATCAC
GTGATGAACCCTTACGACGACGGCATCGGACTCGACGAGTTCGTCGACTGGCTCAACGAG
TCCGGTTGCCCCATCCAGCGCATCGCTGACTATGGCGACTGGCTGCAGCGCTTCGAAACC
GCACTGCGCGCACTGCCCGATCGGCAGCGGCACAGCTCACTGCTGCCGCTGTTGCACAAC
TATCGGCAGCCGGAGCGGCCCGTCCGCGGGTCGATCGCCCCTACCGATCGCTTCCGGGCA
GCGGTGCAAGAGGCCAAGATCGGCCCCGACAAAGACATTCCGCACGTCGGCGCGCCGATC
ATCGTGAAGTACGTCAGCGACCTGCGCCTACTCGGCCTGCTCTGA

FIG. 4 (Cont.)

Amino acid sequence (SEQ ID NO:24)

>uniprot|A0PPD8|A0PPD8_MYCUA Fatty-acid-CoA ligase FadD9

MSPITREERLERRIQDLYANDPQFAAAKPVTAITAAIERPGLPLPQIIET
VMTGYADRPALAQRSVEFVTDAGTGHTTLRLLPHFETISYGELWDRISAL
ADVLSTEQTVKPSDRVCLLGFNSVDYATIDMTLARLGAVAVPLQTSAAIT
QLQPIVAETQPTMIAASVDALADATELALSGQTATRVLVFDHHRQVDAHR
AAVESARERLAGSAVVETLAEAIARGDVPRGASAGSAPGTDVSDDSLALL
IYTSGSTGAPKGAMYPRRNVATFWRKRTWFEGGYEPSITLNFMPMSHVMG
RQILYGTLCNGGTAYFVVKSDLSTLFEDLALVRPTELTFVPRVWDMVFDE
FQSEVDRRLVDGADRVALEAQVKAEIRNDVLGGRYTSALTGSAPISDEMK
AWVEELLDMHLVEGYGSTEAGMILIDGAIRRPAVLDYKLVDVPDLGYFLT
DRPHPRGELLVKTDSLFPGYYQRAEVTADVFDADGFYRTGDIMAEVGPEQ
FVYLDRRNNVLKLSQGEFVTVSKLEAVFGDSPLVRQIYIYGNSARAYLLA
VIVPTQEALDAVPVEELKARLGDSLQEVAKAAGLQSYEIPRDFIIETTPW
TLQNGLLTGIRKLARPQLKKHYGELLEQIYTDLAHGQADELRSLRQSGAD
APVLVTVCRAAAALLGGSASDVQPDAHFTDLGGDSLSALSFTNLLHEIFD
IDVPVGVIVSPANDLQALADYVEAARKPGSSRPTFASVHGASNEQVTEVH
AGDLSLDKFIDAATLAEAPRLPAANTQVRTVLLTGATGFLGRYLALEWLE
RMDLVDGKLICLVRAKSDTEARARLEKTFDSGAPELLAHYRALAGDHLEV
LAGDKGEADLGLDRQTWQRLADTVDLIVDPAALVNHVLPYSQLFGPNALG
TAELLRLALTSKIKPYSYTSTIGVADQIPPSAFTEDADIRVISATRAVDD
SYANGYSNSKWAGEVLLREAHVLCGLPVAVFRCDMILADTTWAGQLNVPD
MFTRMILSLAATGIAPGSFYELAADGARQRAHYDGLPVEFIAEAISTLGA
QSQDGFHTYHVMNPYDDGIGLDEFVDWLNESGCPIQRIADYGDWLQRFET
ALRALPDRQRHSSLLPLLHNYRQPERPVRGSIAPTDRFRAAVQEAKIGPD
KDIPHVGAPIIVKYVSDLRLLGLL

ZP_04027864

Nucleotide sequence (SEQ ID NO:25)

>gi|227980074:564806-568123 Tsukamurella paurometabola DSM 20162
TpauDRAFT_4083016_Cont3, whole genome shotgun sequence ATGTCGATTGAGACGGTGCAGAACGGCGTCCCCGCAGAGGGCTCGGTGCCCCCCGCCGACCAGCAGACCGA
GCGACTGCCGCAGGTGATCGCCAGGATCTTCGCCCAGTTCGCGGATCGTCCGGCCTTCGCGACCCGCGAGG
CGGGGCCGGGGACCCCCTACGCCACCGTCTCCTATCGGGAGATCTGGCGGCGCGTCACCGCGCTGGTGGCC
TCCTGGCAGAGCGAAGTGGCTCCGGGAGACTTCGTCGCCATCCTCGGCTTCACCAGCTCGGACTTCGTGAC
CGTCGACCTCGCGACCACACTGCTCGGCGCCCCGAACGTGCCGCTCCAGGCCGGGGCCCCCGCCGCTCGCA
TCGCGACCATCCTCGATGAGACCCGGCCGAAGATCCTCGCCGTGAGTGCCGATCAGGTCGACCTCGCCCAG
GAGGCTCTGGCCGAGTCCGCGGCTACCCCGCGGGTGGTCGTCTTCGACGGCGAACGCGACGGCTACGAGGG
CATCGAGGCGGACATCCTTTCCGGCTCCGCCCTGCCGGCACCGGAGTTCTTCGCGCCCGAGCCCGGCACCG
ATCCTCTCGTCACGCTCATCTACACATCCGGCAGCACCGGTACCCCGAAGGGGGCCATGTACACCGAGCAG
TTGGTTCGCGATGCCTGGCTCAAGGTGGACAGCATCGTCGACATCGACATGCCGGCCGAGTCGCTCCTGCA
CTTCCTGCCTATGAGCCATATGTACGGGCGCAACTGGCTGATCGCCGGCCTGGCATCGGGCGGACCGGGT
ACTTCGCCGGCGCCTCCGATATGTCCACCCTGTTCGACGACCTCGCCGCCGCCCGGCCCACCGCCATCGGC
CTGGTGCCCCGCGTGTGCGAGCTGATACACCAGCGCTATCTGGCCGTCGAGGCGGACACTGATGCGGAGAC
CGCGCGCGTCGAACTGCGTGACCGGGTACTCGGCGGTCGGCTGCAGGCCGCGATGTGCGGTAGCGCCGCCC
TCTCGTCGGAGCTGCAGACCTTCATGGAGTGGTTGCTCGGAATCGATATCCAGATCGGCTACGGATCCACC

FIG. 4 (Cont.)

GAGGCCGGTGGTGTCATCCGCGACGGAGTGGTCGTTCGGCCGCCGGTCACGGAGTACAAGCTGATCGATGT
CCCCGAACTGGGCTACTTCGTCACCGACTCCCCGCATCCACGCGGCGAACTCCTGGTCAAGTCGACGCAGT
TGATTCCCGGGTACTACAACTCCGACAAGCGGATCCGCGACGACGAAGGCTTCTACCGCACCGGCGATGTG
ATGGCCGAGCTGGGACCCGACCGGCTCGAGTACGTCGACCGGCGGAGCAACGTGATCAAGTTGGCACAGGG
AGAGTTCGTGCCGATCGCCCAACTCGAGGCCATCTACGCCGCCGGTCCCGATGTGCACCAGATCTTCCTGT
ACGGAACCAGCGAACGCTCCTACCTGATCGGCGTCGTCGTGCCCGCGCCGGGACCCGACGGCGAGACCGAT
GCGCAGACCCGCACCCGCGTACTCGATGGCCTGGCCGCGATCGCCCGTGAGAACGATCTCGCTGCCTACGA
GGTGCCGCGCGATGTGCTCATCGAACGTGATCCCTTCTCTCAGGAGAACGGGCTGCGGTCGGGGATCGGCA
AGCTGGTGCGCCCGGCCCTCATCGCCCGCTACGGTGACCGGTTGCACGACCTCTACGCCCAGGCCGACACC
CGTCAACGCGAGGGCTTGCGCGCTCTCGACGCCTCGGGCCCGATCATCGACACCGTGCTCGGGGCGGCTGC
GTTGACGCTCGGCGCGGATATCGCGGACTTCGACGCCGACACTCGATTCGGCGACCTCGGTGGCGACTCGT
TGTCGGCGCTCTCGCTCGCGACGACGCTCGAAGGCCTCTACGACGTGCCCGTCCCCGTGCAGACGATCGTC
GGACCGACCGCCACACTCGGCGGCGTCGCCCGGCACATCGAGAAGGCTCGATCGGGTGGCGTCGCGGCACC
GACCGCCGACTCGGTGCACGGCGTGGGTGCGAGCGTCGCCCGGGCCACCGACCTGACGCTGGAGAAGTTCA
TCGACCCCGAGCTCCTCGCGCTCGCGCCGACGCTTCCCGCGGCGACCGGTGAGCCGAACACCGTGCTGCTC
ACCGGATCCACCGGCTACCTCGGCCGCTTCCTGCTGCTGGACTGGTTGCGACGGGTCGCTCCGCACGGCGG
CACCGTGATCGCGCTGGTGCGCGGCGCCGACGCCGACGATGCGCGACGCCGCGTCACGGCCGCGATCGGTG
ACTCGGATCCTGACCTGACACAAGAGTTCACGTCACTCGCGGAGCATCACCTCCACGTGATCGCCGGTGAC
TTCGGCAGCCCCGCACTCGGACTCGACGATGCCACCTGGAGCGATCTCGCCGGGCGAGTCGATCACGTGGT
GCACTGCGGCGCGCTCGTCAACCACGTGCTGCCCTACGACCAACTGTTCGGTCCCAATGTGGTGGCCACCG
GCGAAGTGGTGCGACTCGCACTCACCACGCGCCGCAAGTCCGTGGATTACGTCTCCACGGTGGCTGTGGTT
CCGCAGGATGACGGCCGCGTCCTGGTCGAGGACGACGATGTTCGCGAGCTCGGCGCCGAACGGCGCATCGG
GGCCGATGCCTACGCGAACGGCTACGCCGTGAGCAAATGGGCGGGCGAAGTGCTGTTGCATGAGGCAGCCG
ACCTGGCGGACCTGCCGGTGCGGGTGTTCCGCTCCGATATGATCTTGGCGCACAGTCGATTCCACGGACAG
TTCAACGAGGTCGACCAGTTCACCCGCCTGCTCCTGAGTATCGCCGAGACCGGACTGGCGCCGGCGTCGTT
CTACACGCCGGATCCGAGTGGACACCGCCCGCACTACGACGGGCTGCCGGTGGACTTCACCGCCGAAGCGA
TCACCACGCTCAGCGCCGCGGGGCGTTCGGGGTACCGGACCTTCCACGTGCTCAACGCCAACGATGACGGC
GTGAGCCTGGACAGCTTCGTCGACTGGATCGCCGCCTCGGGCCGGAGCATCGAACGGATCGACGACTACGA
CACCTGGTTCGCCCGGTTCGAGCAGGCGCTCCAGCAGCTCCCCGATGAGGCGCGCCAGCGGTCGGTGCTGC
CCCTGCTGCACGCGGTGCGCGAGCCGGCTCCGGCCGCCGGGACCTCCGCGCTGTCGGTGGACCGGTTCCGT
GGTGCGGTGCGTGAGACCGGAGTAGGACCGGGGGACATCCCGGTGCTCGATCGCGCCCTGATCGAGAAGTA
CCTGCGCGACTTCGAGACCGCGGGCTGGCTCGCGCCCGGTGCGCGCGACTGA

Amino acid sequence (SEQ ID NO:26)

>gi|227980601|ref|ZP_04027864.1| thioester reductase-like protein
[Tsukamurella paurometabola DSM 20162]

MSIETVQNGVPAEGSVPPADQQTERLPQVIARIFAQFADRPAFATREAGPGTPYATVSYREIWRRVTALV
ASWQSEVAPGDFVAILGFTSSDFVTVDLATTLLGAPNVPLQAGAPAARIATILDETRPKILAVSADQVDL
AQEALAESAATPRVVVFDGERDGYEGIEADILSGSALPAPEFFAPEPGTDPLVTLIYTSGSTGTPKGAMY
TEQLVRDAWLKVDSIVDIDMPAESLLHFLPMSHMYGRNWLIAGLASGGTGYFAGASDMSTLFDDLAAARP
TAIGLVPRVCELIHQRYLAVEADTDAETARVELRDRVLGGRLQAAMCGSAALSSELQTFMEWLLGIDIQI
GYGSTEAGGVIRDGVVVRPPVTEYKLIDVPELGYFVTDSPHPRGELLVKSTQLIPGYYNSDKRIRDDEGF
YRTGDVMAELGPDRLEYVDRRSNVIKLAQGEFVPIAQLEAIYAAGPDVHQIFLYGTSERSYLIGVVVPAP
GPDGETDAQTRTRVLDGLAAIARENDLAAYEVPRDVLIERDPFSQENGLRSGIGKLVRPALIARYGDRLH
DLYAQADTRQREGLRALDASGPIIDTVLGAAALTLGADIADFDADTRFGDLGGDSLSALSLATTLEGLYD
VPVPVQTIVGPTATLGGVARHIEKARSGGVAAPTADSVHGVGASVARATDLTLEKFIDPELLALAPTLPA
ATGEPNTVLLTGSTGYLGRFLLLDWLRRVAPHGGTVIALVRGADADDARRRVTAAIGDSDPDLTQEFTSL
AEHHLHVIAGDFGSPALGLDDATWSDLAGRVDHVVHCGALVNHVLPYDQLFGPNVVATGEVVRLALTTRR

FIG. 4 (Cont.)

KSVDYVSTVAVVPQDDGRVLVEDDDVRELGAERRIGADAYANGYAVSKWAGEVLLHEAADLADLPVRVFR
SDMILAHSRFHGQFNEVDQFTRLLLSIAETGLAPASFYTPDPSGHRPHYDGLPVDFTAEAITTLSAAGRS
GYRTFHVLNANDDGVSLDSFVDWIAASGRSIERIDDYDTWFARFEQALQQLPDEARQRSVLPLLHAVREP
APAAGTSALSVDRFRGAVRETGVGPGDIPVLDRALIEKYLRDFETAGWLAPGARD

ZP_05045132

Nucleotide sequence (SEQ ID NO:27)

>gi|254430111:343253-346687 Cyanobium sp. PCC 7001 scf_1106012173546
genomic scaffold, whole genome shotgun sequence GTGAATGAGTCTTCCGCGGACCAGAGTTCCGGCAACGTTTCCGAGGGGTGGCCTGATGCTTCGGTCACAGC
ACGGGCCCTGCAGGCTCACCTGCGCTACGAACAGATCATCGATGCCATTCTGAGCGGCTACGCCGAGCGCC
CTGCTCTGGCGGAGCGTTCCTACCTGGTGCGGCCGGACCCGAGCACAGGTCAAACGGTGCGTGTCCACGAG
CAGGCCTTCCGCTCGATCAGCTACCGAACCCTGCAGGAACGGGTTCATGCCCTCACCATGGCCTGGCGCCT
TCATCCCGATAGCCCGGTGCAAGCGGGAGCCTTCGTGGTGCTGGTGGGATTTGCCAGCATCGATTACGCCG
TTCTTGATCTGGCACTGGCCTACACCAAGGGCGTGCCGGTGCCCCTGTCACCGAACCATTCCAGCGAGGAC
GATGACGCCATCCTCGGCACAGTCCAGCCCGTCACTCTGGCGGTATCGATCAGTGAGTTCTCTGGCTGTGT
CGACCTGATCGCCCGATCGACGTCGATCCGAACTGTGATCGTCTTTGACCTTGACCCTGCCGTCGACTGCG
AGCGCGCCGCACTGGAGAGCGGCATCCGGGCACTCAACGAGAAGGGGTCAGACGTTGTCGTTCAGACACTG
CAGGATCTGATTGACGTTGGGAGAGACGCAGAGTTCAGCTTCCTGCCGATCCAGGCGCAGGATCAAGATGA
CCTGGCACTTCTGATTCACACATCCGGCAGCACAGGCACACCCAAGGGAGCCTGCATCTCATCCCGTGCAC
TGATCAACACCTGGCGCCATGTTTCCGGTCCCTATCCAAAAGTGACCGTGGTTCTGGCACCCTTCCACCAC
ATGATGGGACGAGACTCGATGATCACGGCATTGGGCGCGGGCGGCACCGCCTACTTCACGCTCAGGCCTGA
CCTTTCGACCGTGATTGAAGACATCAGACTGGCACGGCCCACAGGCCTGGTGCTGTTTCCCCGCCTCTGCG
AAGTGATCGAACACCACCTGACTACTGCGCCGGAGTATTCAGGCAACGAGATCCTCGGAGGCAGACTGCAA
TCCATTGTGGTGGCCTCGGCTCCGATCACGCCACGCTTGAAGGCATCCCTGGAGTGCCTCCTTGGGGTGCC
TGTGAGCGAAGGCTACAGCAGCACGGAAACAGCCAGTGGCGGGCTGGCGATGAATGGACTGCTGAACCGCA
ACAACATTCTCGCGTATCGCCTTCGCGATGTGCCCGAGGCAGGGTATTCAGTGAATGATCGGCCCTTTCCG
CGCGGAGAACTCTGCGTGAAGACCCGCTTCGGTATCTCAGGCTATTTCAGAAATCCAGAGGCCACTGCAGA
GCTGTTCGACGACGATGGCTTCTATTGCACCGGTGACATCGTTGAAGAGCGGGCCCCCGATCAAATCGCCA
TCATCGACCGGCGAAAGAATGTCATCAAGCTGGCGCAGGGTGAATATGTCGCTGTGGGCAGGCTGGAACAG
CTTTTCCAGGAAGGTTGTGGTTGCGTGCAGCAGATTCACCTCCACGGCGACAGCACAAGGGCCTATCTGCT
GGCAGTCGTGGTACCTGATCGCAACACCCCTTGCACCGCCCGGGTCACGGCAGGCCAGTGAGGCCGAGTTAA
AGGCACGGGTGCGCGAGGAGATTCTCACCTTGGCAAACCAACGGGAGCTGCGCGGCTTCGAGATCCCTCGA
GACCTGATCCTGGCGGAGGAACCCTTCTCCCAGCAGAACGGTCTGCTGTCGTCCTTGGGTAAGCCGATCCG
CCCGGCCATCCGCGCGCGCTACCGCAGCCGGCTGGAGAGCCTGTATGCCAGCCATGAGGCCACCCGAGGCA
CTGAGCTCGAGGCCATCAGAGCGTCAGCTGGCGCGGTGGATGTGGAAACCACCCTGTTGGCGCTGCTGAGC
AGCACGCTGGGTGTGGTGTGTGGGGCTGCCGATCGGCAGACGAGTTTCCGCGAGCTGGGGGGCGACTCCCT
GGCCGCTGTGCAGCTGGCGATGGAGATCAAGAAGCAGTTCGGGGTGGGGCTGGAAGGGAGCCAGATTCTCG
GGCCGGGCGGCACGGTGGAAGCGTGGGCGCGGAGGATCCACACCGCCTCCATCCAGCAGGCCCCGCACCAG
CGGGTTGGCAGTCCCCTCGCCGCCATTCCGGCCGAGGGGTGGCTGAAGCCGGACCACTACAGGCTGGAGAA
CCTGATCGGGATTCCCATCGGTACACCCTCAGCCGAGGTGGCCAGGCCCACAGGCGGGCCCCCTACGGTTC
TGCTCACCGGTGCCACCGGTTTTCTGGGGGGGCGCTTGTGCCTGGAGTGGCTGCAACGGCTGGCTGGCCAG
GGGGGCAGGCTGATCTGTCTGGTGCGCCCCTCGAACAGCCATTCCGCCTGGGAGCGACTGAGGAACCGCTT
CTCCCATCTGGAACCCGAGCAGGTGGCACGCTTCCGCGAGCTGGCGGGAAGGCATCTGGAGGTGATTCCGG
CGGACATCGGAGAGCCCGGCCTGGGGCTTGAACCGGGTTGCCAGGAGCGGCTCGCCACTGAGGTGGACGCG
ATCTGTCACTGCGCAGCGGAAGTGAATCACCGGCTGCCCTATCGCCACCTCTACCGGCCCAATGTGATCGG
CACCGCGGAGATCATTCACCTGGCGATCACGACGCGGCTGAAATCGGTGGACTTCATCTCCAGCATCGGGG
TGGCTTCCCTGCCCCGGCGGCCGGGAGGGAGCATCCCGGTGGAGGGCGGCTACGCCCGGGGCTACTTCGCC

FIG. 4 (Cont.)

AGCAAGTGGGCTTGCGAGCAACTGCTGCGCTCCACCCATGACTGCACCGGTGTGCCCGTACGGGTGATTCG
GCCCAGCCTCATTCTTCCCGATCGTGTGCTGGCCGGGGAGATGAACCCGGACGATCTGCTTTCAAGACTGC
TGTACAGCATCCTGGTGACCGGGATCGCCCCCGGGTGCTTTGGGGAGGAGTCGCAGAACAGTGGACGATCG
GGGTTCTCGGTGCAGGGCCTCCCCGTCGACCAGTTGGCGCAGACCATCCTTGCCCTCGGGGAAGCGCGCAC
GGAGGGATTTCATGTGCTCAACCTCAACGCTGACAGTGGCAGCGGTGTTCCCCTGGATGCCATCCTCCAGG
ACATCGCCGCCAAAGGAATCAGGCTGCGACGGGTGGAGGGCTATGACCTCTGGCTCGACGCGATCACAACC
CGCCTGCGTCGCCTGCCAGCCGAGCAACGGGCCCGTTCCCTGCTGGATGTGGCGGAAGCCTATGCAGGATC
AGCAGGCCAGACAACGCAGAGCAGCGGTGAAATGCAGGCGGGCAGCAGCTCCTGCCCGGAGGAGATCACCA
GCCTGCAACCGGACTTCAGTAGGGCCTACAGGCGCAAGATCGTGGATGATCTGGCTCGGTGGGGGCTGATC
GAGCCTCCAGGACCCGTGGATCAGTGA

Amino acid sequence (SEQ ID NO:28)

>gi|254431429|ref|ZP_05045132.1| putative long-chain fatty-acid--CoA ligase [Cyanobium sp. PCC 7001]

MNESSADQSSGNVSEGWPDASVTARALQAHLRYEQIIDAILSGYAERPALAERSYLVRPDPSTGQTVRVH
EQAFRSISYRTLQERVHALTMAWRLHPDSPVQAGAFVVLVGFASIDYAVLDLALAYTKGVPVPLSPNHSS
EDDDAILGTVQPVTLAVSISEFSGCVDLIARSTSIRTVIVFDLDPAVDCERAALESGIRALNEKGSDVVV
QTLQDLIDVGRDAEFSFLPIQAQDQDDLALLIHTSGSTGTPKGACISSRALINTWRHVSGPYPKVTVVLA
PFHHMMGRDSMITALGAGGTAYFTLRPDLSTVIEDIRLARPTGLVLFPRLCEVIEHHLTTAPEYSGNEIL
GGRLQSIVVASAPITPRLKASLECLLGVPVSEGYSSTETASGGLAMNGLLNRNNILAYRLRDVPEAGYSV
NDRPFPRGELCVKTRFGISGYFRNPEATAELFDDDGFYCTGDIVEERAPDQIAIIDRRKNVIKLAQGEYV
AVGRLEQLFQEGCGCVQQIHLHGDSTRAYLLAVVVPDRNTLAPPGSRQASEAELKARVREEILTLANQRE
LRGFEIPRDLILAEEPFSQQNGLLSSLGKPIRPAIRARYRSRLESLYASHEATRGTELEAIRASAGAVDV
ETTLLALLSSTLGVVCGAADRQTSFRELGGDSLAAVQLAMEIKKQFGVGLEGSQILGPGGTVEAWARRIH
TASIQQAPHQRVGSPLAAIPAEGWLKPDHYRLENLIGIPIGTPSAEVARPTGGPPTVLLTGATGFLGGRL
CLEWLQRLAGQGGRLICLVRPSNSHSAWERLRNRFSHLEPEQVARFRELAGRHLEVIPADIGEPGLGLEP
GCQERLATEVDAICHCAAEVNHRLPYRHLYRPNVIGTAEIIHLAITTRLKSVDFISSIGVASLPRRPGGS
IPVEGGYARGYFASKWACEQLLRSTHDCTGVPVRVIRPSLILPDRVLAGEMNPDDLLSRLLYSILVTGIA
PGCFGEESQNSGRSGFSVQGLPVDQLAQTILALGEARTEGFHVLNLNADSGSGVPLDAILQDIAAKGIRL
RRVEGYDLWLDAITTRLRRLPAEQRARSLLDVAEAYAGSAGQTTQSSGEMQAGSSSCPEEITSLQPDFSR
AYRRKIVDDLARWGLIEPPGPVDQ

YP 882653.1

Nucleotide sequence (SEQ ID NO:29)

>uniprot|A0QIB5|A0QIB5_MYCA1 Putative acyl-CoA dehydrogenase

ATGTCGACTGCCACCCATGACGAACGACTCGACCGTCGCGTCCACGAACTCATCGCCACC
GACCCGCAATTCGCCGCCGCCCAACCCGACCCGGCGATCACCGCCGCCCTCGAACAGCCC
GGGCTGCGGCTGCCGCAGATCATCCGCACCGTGCTCGACGGCTACGCCGACCGGCCGGCG
CTGGGACAGCGCGTGGTGGAGTTCGTCACGGACGCCAAGACCGGGCGCACGTCGGCGCAG
CTGCTCCCCCGCTTCGAGACCATTACGTACGGCGAAGTGGCGCAGCGTGTTTCGGCGCTG
GGCCGCGCCCTGTCTGACGACGCGGTGCACCCCGGCGACCGGGTGTGCGTGCTGGGCTTC
AACAGCGTCGACTACGCCACCATCGACATGGCGCTGGGCGCCATCGGCGCCGTCTCGGTG
CCGCTGCAGACCAGCGCGGCAATCAGCTCGCTGCAGCCGATCGTGGCCGAGACCGAGCCC

FIG. 4 (Cont.)

ACCCTGATCGCGTCCAGCGTGAACCAGCTGTCCGACGCGGTGCAGCTGATCACCGGCGCC
GAGCAGGCGCCCACCCGGCTGGTGGTGTTCGACTACCACCCGCAGGTCGACGACCAGCGC
GAGGCCGTCCAGGACGCCGCGGCGCGGCTGTCCGGCACCGGCGTGGCCGTCCAGACGCTG
GCCGAGCTGCTGGAGCGCGGCAAGGACCTGCCCGCCGTCGCGGAGCCGCCCGCCGACGAG
GACTCGCTGGCCCTGCTGATCTACACCTCCGGGTCCACCGGCGCCCCCAAGGGCGCGATG
TACCCGCAGAGCAACGTCGGCAAGATGTGGCGCCGCGGCAGCAAGAACTGGTTCGGCGAG
AGCGCCGCGTCGATCACCCTGAATTTCATGCCGATGAGCCACGTGATGGGCCGAAGCATC
CTCTACGGCACGCTGGGCAACGGCGGCACCGCCTACTTCGCCGCCCGCAGCGACCTGTCC
ACCCTGCTCGAGGACCTCGAGCTGGTGCGGCCCACCGAGCTCAACTTCGTCCCGCGGATC
TGGGAGACGCTGTACGGCGAATTCCAGCGTCAGGTCGAGCGGCGGCTCTCCGAGGCCGGG
GACGCCGGCGAACGTCGCGCCGTCGAGGCCGAGGTGCTGGCCGAGCAGCGCCAGTACCTG
CTGGGCGGGCGGTTCACCTTCGCGATGACGGGCTCGGCGCCCATCTCGCCCGAGCTGCGC
AACTGGGTCGAGTCGCTGCTCGAAATGCACCTGATGGACGGCTACGGCTCCACGGAGGCC
GGAATGGTGTTGTTCGACGGGGAGATTCAGCGCCCGCCGGTGGTCGACTACAAGCTGGTC
GACGTGCCGGACCTGGGCTACTTCAGCACCGACCGGCCGCATCCGCGCGGCGAGCTGCTG
CTGCGCACCGAGAACATGTTCCCGGGCTACTACAAGCGGGCCGAAACCACCGCGGGCGTC
TTCGACGAGGACGGCTACTACCGCACCGGCGACGTGTTCGCCGAGATCGCCCCGGACCGG
CTGGTCTACGTCGACCGCCGCAACAACGTGCTCAAGCTGGCGCAGGGCGAATTCGTCACG
CTGGCCAAGCTGGAGGCGGTGTTCGGCAACAGCCCGCTGATCCGCCAGATCTACGTCTAC
GGCAACAGCGCCCAGCCCTACCTGCTGGCGGTCGTGGTGCCCACCGAGGAGGCGCTGGCC
TCGGGTGACCCCGAGACGCTCAAGCCCAAGATCGCCGACTCGCTGCAGCAGGTCGCCAAG
GAGGCCGGCCTGCAGTCCTACGAGGTGCCGCGCGACTTCATCATCGAGACCACCCCGTTC
AGCCTGGAAAACGGTCTGCTGACCGGGATCCGGAAGCTGGCGTGGCCGAAACTGAAGCAG
CACTACGGGGAACGGCTGGAGCAGATGTACGCCGACCTGGCCGCCGGACAGGCCGACGAG
CTGGCCGAGCTGCGCCGCAACGGTGCCCAGGCGCCGGTGTTGCAGACCGTGAGCCGCGCC
GCGGGCGCCATGCTGGGTTCGGCCGCCTCCGACCTGTCCCCCGACGCCCACTTCACCGAT
CTGGGCGGAGACTCGTTGTCGGCGTTGACATTCGGCAACCTGCTGCGCGAGATCTTCGAC
GTCGACGTGCCGGTGGGCGTGATCGTCAGCCCGGCCAACGACCTGGCGGCCATCGCGAGC
TACATCGAGGCCGAGCGGCAGGGCAGCAAGCGCCCGACGTTCGCCTCGGTGCACGGCCGG
GACGCGACCGTGGTGCGCGCCGCCGACCTGACGCTGGACAAGTTCCTCGACGCCGACACG
CTGGCCTCCGCGCCGAACCTGCCCAAGCCGGCCACCGAGGTGCGCACCGTGCTGCTGACC
GGCGCCACCGGCTTCCTGGGCCGCTACCTGGCCCTGGAATGGCTGGAGCGGATGGACATG
GTGGACGGCAAGGTCATCGCCCTGGTCCGGGCCCGCTCCGACGAGGAGGCACGCGCCCGG
CTGGACAAGACCTTCGACAGCGGCGACCCGAAGCTGCTCGCGCACTACCAGCAGCTGGCT
GCCGATCACCTGGAGGTCATCGCCGGCGACAAGGGCGAGGCCAATCTGGGCCTGCGCCAA
GATGTTTGGCAACGGCTGGCCGACACGGTCGACGTGATCGTCGACCCCGCCGCGCTGGTC
AACCACGTGTTGCCGTACAGCGAGCTGTTCGGGCCCAACGCCCTGGGCACCGCGGAGCTG
ATCCGGCTGGCGCTGACGTCCAAGCAGAAGCCGTACACCTACGTGTCCACCATCGGCGTG
GGCGACCAGATCGAGCCGGGCAAGTTCGTCGAGAACGCCGACATCCGGCAGATGAGCGCC
ACCCGGGCGATCAACGACAGCTACGCCAACGGCTACGGCAACAGCAAGTGGGCCGGCGAG
GTGCTGCTGCGCGAGGCGCACGACCTGTGCGGGCTGCCCGTCGCGGTGTTCCGCTGCGAC
ATGATCCTGGCCGACACCACGTATGCCGGGCAGCTCAACCTGCCGGACATGTTCACCCGG
CTGATGCTGAGCCTGGTGGCCACCGGGATCGCGCCCGGCTCGTTCTACGAGCTCGACGCC
GACGGCAACCGGCAGCGGGCGCACTACGACGGCCTGCCGGTCGAGTTCATCGCCGCGGCG
ATCTCGACGCTGGGTTCGCAGATCACCGACAGCGACACCGGCTTCCAGACCTACCACGTG
ATGAACCCCTACGATGACGGCATCGGTCTGGACGAGTACGTCGATTGGCTGGTGGACGCC
GGCTATTCGATCGAGCGGATCGCCGACTACTCCGAATGGCTGCGGCGGTTCGAGACCTCG
CTGCGGGCCCTGCCGGACCGGCAGCGCCAGTACTCGCTGCTGCCGCTGCTGCACAACTAC
CGCACGCCCGAGAAGCCGATCAACGGGTCGATAGCTCCCACCGACGTGTTCCGGGCAGCG
GTGCAGGAGGCGAAAATCGGCCCCGACAAAGACATTCCGCACGTGTCGCCGCCGGTCATC
GTCAAGTACATCACCGACCTGCAGCTGCTCGGGCTGCTCTGA

FIG. 4 (Cont.)

Amino acid sequence (SEQ ID NO:30)

>uniprot|A0QIB5|A0QIB5_MYCA1 Putative acyl-CoA dehydrogenase

MSTATHDERLDRRVHELIATDPQFAAAQPDPAITAALEQPGLRLPQIIRT
VLDGYADRPALGQRVVEFVTDAKTGRTSAQLLPRFETITYGEVAQRVSAL
GRALSDDAVHPGDRVCVLGFNSVDYATIDMALGAIGAVSVPLQTSAAISS
LQPIVAETEPTLIASSVNQLSDAVQLITGAEQAPTRLVVFDYHPQVDDQR
EAVQDAAARLSGTGVAVQTLAELLERGKDLPAVAEPPADEDSLALLIYTS
GSTGAPKGAMYPQSNVGKMWRRGSKNWFGESAASITLNFMPMSHVMGRSI
LYGTLGNGGTAYFAARSDLSTLLEDLELVRPTELNFVPRIWETLYGEFQR
QVERRLSEAGDAGERRAVEAEVLAEQRQYLLGGRFTFAMTGSAPISPELR
NWVESLLEMHLMDGYGSTEAGMVLFDGEIQRPPVVDYKLVDVPDLGYFST
DRPHPRGELLLRTENMFPGYYKRAETTAGVFDEDGYYRTGDVFAEIAPDR
LVYVDRRNNVLKLAQGEFVTLAKLEAVFGNSPLIRQIYVYGNSAQPYLLA
VVVPTEEALASGDPETLKPKIADSLQQVAKEAGLQSYEVPRDFIIETTPF
SLENGLLTGIRKLAWPKLKQHYGERLEQMYADLAAGQADELAELRRNGAQ
APVLQTVSRAAGAMLGSAASDLSPDAHFTDLGGDSLSALTFGNLLREIFD
VDVPVGVIVSPANDLAAIASYIEAERQGSKRPTFASVHGRDATVVRAADL
TLDKFLDADTLASAPNLPKPATEVRTVLLTGATGFLGRYLALEWLERMDM
VDGKVIALVRARSDEEARARLDKTFDSGDPKLLAHYQQLAADHLEVIAGD
KGEANLGLRQDVWQRLADTVDVIVDPAALVNHVLPYSELFGPNALGTAEL
IRLALTSKQKPYTYVSTIGVGDQIEPGKFVENADIRQMSATRAINDSYAN
GYGNSKWAGEVLLREAHDLCGLPVAVFRCDMILADTTYAGQLNLPDMFTR
LMLSLVATGIAPGSFYELDADGNRQRAHYDGLPVEFIAAAISTLGSQITD
SDTGFQTYHVMNPYDDGIGLDEYVDWLVDAGYSIERIADYSEWLRRFETS
LRALPDRQRQYSLLPLLHNYRTPEKPINGSIAPTDVFRAAVQEAKIGPDK
DIPHVSPPVIVKYITDLQLLGLL

<u>YP 887275.1</u>

Nucleotide sequence (SEQ ID NO:31)

>uniprot|A0QWI7|A0QWI7_MYCS2 NAD dependent epimerase/dehydratase family protein

ATGACGATCGAAACGCGCGAAGACCGCTTCAACCGGCGCATTGACCACTTGTTCGAAACC
GACCCGCAGTTCGCCGCCGCCCGTCCCGACGAGGCGATCAGCGCGGCTGCCGCCGATCCG
GAGTTGCGCCTTCCTGCCGCGGTCAAACAGATTCTGGCCGGCTATGCGGACCGCCCTGCG
CTGGGCAAGCGCGCCGTCGAGTTCGTCACCGACGAAGAAGGCCGCACCACCGCGAAGCTC
CTGCCCCGCTTCGACACCATCACCTACCGTCAGCTCGCAGGCCGGATCCAGGCCGTGACC
AATGCCTGGCACAACCATCCGGTGAATGCCGGTGACCGCGTGGCCATCCTGGGTTTCACC
AGTGTCGACTACACGACGATCGACATCGCCCTGCTCGAACTCGGCGCCGTGTCCGTACCG
CTGCAGACCAGTGCGCCGGTGGCCCAACTGCAGCCGATCGTCGCCGAGACCGAGCCCAAG
GTGATCGCGTCGAGCGTCGACTTCCTCGCCGACGCAGTCGCTCTCGTCGAGTCCGGGCCC
GCGCCGTCGCGACTGGTGGTGTTCGACTACAGCCACGAGGTCGACGATCAGCGTGAGGCG
TTCGAGGCGGCCAAGGGCAAGCTCGCAGGCACCGGCGTCGTCGTCGAGACGATCACCGAC
GCACTGGACCGCGGGCGGTCACTCGCCGACGCACCGCTCTACGTGCCCGACGAGGCCGAC
CCGCTGACCCTTCTCATCTACACCTCCGGCAGCACCGGCACTCCCAAGGGCGCGATGTAC
CCCGAGTCCAAGACCGCCACGATGTGGCAGGCCGGGTCCAAGGCCCGGTGGGACGAGACC
CTCGGCGTGATGCCGTCGATCACCCTGAACTTCATGCCCATGAGTCACGTCATGGGGCGC

FIG. 4 (Cont.)

GGCATCCTGTGCAGCACACTCGCCAGCGGCGGAACCGCGTACTTCGCCGCACGCAGCGAC
CTGTCCACCTTCCTGGAGGACCTCGCCCTCGTGCGGCCCACGCAGCTCAACTTCGTTCCT
CGCATCTGGGACATGCTGTTCCAGGAGTACCAGAGCCGCCTCGACAACCGCCGCGCCGAG
GGATCCGAGGACCGAGCCGAAGCCGCAGTCCTCGAAGAGGTCCGCACCCAACTGCTCGGC
GGGCGATTCGTTTCGGCCCTGACCGGATCGGCTCCCATCTCGGCGGAGATGAAGAGCTGG
GTCGAGGACCTGCTCGACATGCATCTGCTGGAGGGCTACGGCTCCACCGAGGCCGGCGCG
GTGTTCATCGACGGGCAGATCCAGCGCCCGCCGGTCATCGACTACAAGCTGGTCGACGTG
CCCGATCTCGGCTACTTCGCCACGGACCGGCCCTACCCGCGCGGCGAACTTCTGGTCAAG
TCCGAGCAGATGTTCCCCGGCTACTACAAGCGTCCGGAGATCACCGCCGAGATGTTCGAC
GAGGACGGGTACTACCGCACCGGCGACATCGTCGCCGAGCTCGGGCCCGACCATCTCGAA
TACCTCGACCGCCGCAACAACGTGCTGAAACTGTCGCAGGGCGAATTCGTCACGGTCTCC
AAGCTGGAGGCGGTGTTCGGCGACAGCCCCCTGGTACGCCAGATCTACGTCTACGGCAAC
AGCGCGCGGTCCTATCTGCTGGCGGTCGTGGTCCCGACCGAAGAGGCACTGTCACGTTGG
GACGGTGACGAACTCAAGTCGCGCATCAGCGACTCACTGCAGGACGCGGCACGAGCCGCC
GGATTGCAGTCGTATGAGATCCCGCGTGACTTCCTCGTCGAGACAACACCTTTCACGCTG
GAGAACGGCCTGCTGACCGGTATCCGCAAGCTGGCCCGGCCGAAACTGAAGGCGCACTAC
GGCGAACGCCTCGAACAGCTCTACACCGACCTGGCCGAGGGGCAGGCCAACGAGTTGCGC
GAGTTGCGCCGCAACGGAGCCGACCGGCCCGTGGTCGAGACCGTCAGCCGCGCCGCGGTC
GCACTGCTCGGTGCCTCCGTCACGGATCTGCGGTCCGATGCGCACTTCACCGATCTGGGT
GGAGATTCGTTGTCGGCCTTGAGCTTCTCGAACCTGTTGCACGAGATCTTCGATGTCGAC
GTGCCGGTCGGCGTCATCGTCAGCCCGGCCACCGACCTGGCAGGCGTCGCGGCCTACATC
GAGGGCGAACTGCGCGGCTCCAAGCGCCCCACATACGCGTCGGTGCACGGGCGCGACGCC
ACCGAGGTGCGCGCGCGTGATCTCGCCCTGGGCAAGTTCATCGACGCCAAGACCCTGTCC
GCCGCGCCGGGTCTGCCGCGTTCGGGCACCGAGATCCGCACCGTGCTGCTGACCGGCGCC
ACCGGGTTCCTGGGCCGCTATCTGGCGCTGGAATGGCTGGAGCGCATGGACCTGGTGGAC
GGCAAGGTGATCTGCCTGGTGCGCGCCCGCAGCGACGACGAGGCCCGGGCGCGTCTGGAC
GCCACGTTCGACACCGGGGACGCGACACTGCTCGAGCACTACCGCGCGCTGGCAGCCGAT
CACCTCGAGGTGATCGCCGGTGACAAGGGCGAGGCCGATCTGGGTCTCGACCACGACACG
TGGCAGCGACTGGCCGACACCGTCGATCTGATCGTCGATCCGGCCGCCCTGGTCAATCAC
GTCCTGCCGTACAGCCAGATGTTCGGACCCAATGCGCTCGGCACCGCCGAACTCATCCGG
ATCGCGCTGACCACCACGATCAAGCCGTACGTGTACGTCTCGACGATCGGTGTGGGACAG
GGCATCTCCCCCGAGGCGTTCGTCGAGGACGCCGACATCCGCGAGATCAGCGCGACGCGC
CGGGTCGACGACTCGTACGCCAACGGCTACGGCAACAGCAAGTGGGCCGGCGAGGTCCTG
CTGCGGGAGGCGCACGACTGGTGTGGTCTGCCGGTCTCGGTGTTCCGCTGCGACATGATC
CTGGCCGACACGACCTACTCGGGTCAGCTGAACCTGCCGGACATGTTCACCCGCCTGATG
CTGAGCCTCGTGGCGACCGGCATCGCGCCCGGTTCGTTCTACGAACTCGATGCGGACGGC
AACCGGCAGCGCGCCCACTACGACGGGCTGCCCGTGGAGTTCATCGCCGAGGCGATCTCC
ACCATCGGCTCGCAGGTCACCGACGGATTCGAGACGTTCCACGTGATGAACCCGTACGAC
GACGGCATCGGCCTCGACGAGTACGTGGACTGGCTGATCGAGGCCGGCTACCCCGTGCAC
CGCGTCGACGACTACGCCACCTGGCTGAGCCGGTTCGAAACCGCACTGCGGGCCCTGCCG
GAACGGCAACGTCAGGCCTCGCTGCTGCCGCTGCTGCACAACTATCAGCAGCCCTCACCG
CCCGTGTGCGGTGCCATGGCACCCACCGACCGGTTCCGTGCCGCGGTGCAGGACGCGAAG
ATCGGCCCCGACAAGGACATTCCGCACGTCACGGCCGACGTGATCGTCAAGTACATCAGC
AACCTGCAGATGCTCGGATTGCTGTAA

Amino acid sequence (SEQ ID NO:32)

>uniprot|A0QWI7|A0QWI7_MYCS2 NAD dependent epimerase/dehydratase family protein

MTIETREDRFNRRIDHLFETDPQFAAARPDEAISAAAADPELRLPAAVKQ
ILAGYADRPALGKRAVEFVTDEEGRTTAKLLPRFDTITYRQLAGRIQAVT

FIG. 4 (Cont.)

NAWHNHPVNAGDRVAILGFTSVDYTTIDIALLELGAVSVPLQTSAPVAQL
QPIVAETEPKVIASSVDFLADAVALVESGPAPSRLVVFDYSHEVDDQREA
FEAAKGKLAGTGVVVETITDALDRGRSLADAPLYVPDEADPLTLLIYTSG
STGTPKGAMYPESKTATMWQAGSKARWDETLGVMPSITLNFMPMSHVMGR
GILCSTLASGGTAYFAARSDLSTFLEDLALVRPTQLNFVPRIWDMLFQEY
QSRLDNRRAEGSEDRAEAAVLEEVRTQLLGGRFVSALTGSAPISAEMKSW
VEDLLDMHLLEGYGSTEAGAVFIDGQIQRPPVIDYKLVDVPDLGYFATDR
PYPRGELLVKSEQMFPGYYKRPEITAEMFDEDGYYRTGDIVAELGPDHLE
YLDRRNNVLKLSQGEFVTVSKLEAVFGDSPLVRQIYVYGNSARSYLLAVV
VPTEEALSRWDGDELKSRISDSLQDAARAAGLQSYEIPRDFLVETTPFTL
ENGLLTGIRKLARPKLKAHYGERLEQLYTDLAEGQANELRELRRNGADRP
VVETVSRAAVALLGASVTDLRSDAHFTDLGGDSLSALSFSNLLHEIFDVD
VPVGVIVSPATDLAGVAAYIEGELRGSKRPTYASVHGRDATEVRARDLAL
GKFIDAKTLSAAPGLPRSGTEIRTVLLTGATGFLGRYLALEWLERMDLVD
GKVICLVRARSDDEARARLDATFDTGDATLLEHYRALAADHLEVIAGDKG
EADLGLDHDTWQRLADTVDLIVDPAALVNHVLPYSQMFGPNALGTAELIR
IALTTTIKPYVYVSTIGVGQGISPEAFVEDADIREISATRRVDDSYANGY
GNSKWAGEVLLREAHDWCGLPVSVFRCDMILADTTYSGQLNLPDMFTRLM
LSLVATGIAPGSFYELDADGNRQRAHYDGLPVEFIAEAISTIGSQVTDGF
ETFHVMNPYDDGIGLDEYVDWLIEAGYPVHRVDDYATWLSRFETALRALP
ERQRQASLLPLLHNYQQPSPPVCGAMAPTDRFRAAVQDAKIGPDKDIPHV
TADVIVKYISNLQMLGLL

ZP_05224908

Nucleotide sequence (SEQ ID NO:33)

>gi|163719654:2489-6013 Mycobacterium intracellulare ATCC 13950 NZ_ABIN01000072, whole genome shotgun sequence ATGTCGACTGCCATTCATGACGAACACCTCGACCGTCGCATCGAGGAACTCATCGCCAACGACCCCCAAT
TCGCCGCCGCCCGACCGGACCCGGCCATCACCGCCGCCACCGAAGCGCCCGGGCTGCGGCTGCCGCAGAT
CATCCGGACCGTGCTCGACGGCTACGCCGACCGGCCTGCCCTGGCGCAGCGCGTCGTGGAGTTCGTCACC
GACGCCAAGACCGGGCGGACGACGGCCGAGCTGCTCCCCCGTTTCGAGACCATCACGTATGGCGAACTCG
GCGAACGGGTTTCGGCCCTCGGCCGTGCCTGGGCCGGCGACGCGGTGCGCCCCGGCGACCGCGTCTGCGT
GCTCGGCTTCAACAGCGTTGACTACGCCACCATCGACATCGCGCTGGGCACCATCGGGGCCGTGTCGGTG
CCGCTGCAGACCAGCGCGGCGATCTCCTCGTTGCAGCCGATCGTCGCCGAGACCGAGCCCAGCCTGATCG
CCTCGAGCGTCAACCAGCTGCCCGACGCGGTGGAGCTGATCCTGGCCGGCGACCACGTGCCCGGCAAGCT
CGTCGTGTTCGACTACCAGCCCCAGGTCGACGACCAGCGCGAGGCCGTGGAGGCCGCCGCCGCGCGGTTG
GCCGACTCCGGCGTCGCGGTCGAGGCTCTCGCCGACGTGCTGCGGCGCGGCAAGGACCTGCCGGCCGTCG
AGCCGCCGGCGAGCGACGAGGACTCGCTGGCCCTGCTGATCTACACCTCCGGCAGCACCGGCGCGCCCAA
GGGCGCGATGTACCCGCAGAGCAACGTCGGCAAGATGTGGCGGCGCGGGAGCAAGAACTGGTTCGGGGAA
AGCGCCGCGTCGATCACCCTCAACTTCATGCCGATGAGCCACGTCATGGGGCGCGGAATCCTCTACGGCA
CGCTGGGCAACGGCGGCACCGCGTACTTCGCCGCCCCGCAGCGACCTGTCCACCCTGCTCGAGGACCTCGA
GTTGGTGCGGCCCACCGAGATGAACTTCGTCCCCCGCATCTGGGAGACGCTGTACGGCGAATTCCAGCGC
CAGGTCGAGCGGCGGCTGGCCGACGGCGATGCGGGCCCGGAGGCCCGCGAGACTGTGGCGGCTGCGGTGT
TGGAAGAACAGCGCCAGTACCTGCTGGGCGGGCGGTTCATCTTCGCGATGACGGGCTCGGCACCCACCTC
GCCGGAGCTCAAGGCGTGGGCCGAGTCGCTCCTGCAGATGCACCTGATGGACGGCTACGGCTCCACCGAG
GCCGGAATGGTGTTGTTCGACGGGGAGATTCAGCGTCCGCCGGTTATTGATTACAAGCTGGTCGACGTTC
CGGATCTGGGCTATTTCAGCACCGACCGTCCGCATCCGCGCGGTGAGTTGTTGCTGCGGACCGAGAACAT
GTTCCCGGGTTATTACAAGCGGGCCGAGACCACCGCGAACGTGTTCGACGAGGACGGTTATTACCGCACC

FIG. 4 (Cont.)

GGTGACGTGTTCGCCGAGATCGCGCCGGACCGGCTGGTGTATGTCGATCGCCGCAACAACGTGCTCAAGT
TGGCCCAGGGCGAGTTCGTGACGCTGGCCAAGCTGGAGGCGGTGTTCGGCAACAGCCCGCTGATCCGCCA
GATCTACGTTTACGGCAACAGCTCCCAGCCCTACCTGCTGGCCGTGGTGGTGCCGACCGAGGAAGCGTTG
GCGGACAACGATCTTGAGTCGCTCAAGCCGAAGATCGCCGACTCGCTGCAGAAGGTCGCCAAGGAGACCG
GCCTGCAGTCCTACGAGGTGCCGCGCGACTTCATCATCGAGACCACGCCGTTCACCCTGGAAAACGGCCT
GCTGACCGGGATCCGCAAGCTGGCGTGGCCCAAGCTCAAGGCGCACTACGGGGATCGGCTCGAGCAGATG
TATGCCGAGCTGGCCGCGGGACAGGCCAACGAGTTGGCCGAACTGCGCCGCAGCGGCGCGGCGGCGCCGG
TGGCCCAGACCGTGAGCCGGGCCGCGGCCGCCCTGCTGGGTGCGACGGCCGGGGATCTGTCCGCAGATGC
CCACTTCACCGATCTTGGTGGAGACTCGTTGTCGGCGTTGACCTTCGGCAACCTGCTGCGCGAGATCTTC
GATGTCGACGTGCCGGTGGGGGTGATCGTCAGCCCGGCCAACGACCTGGCGGGGATCGCCGCCTACATCG
AGGCCGAGCGGCAGGGCTCCAAGCGCCCGACGTTCGCCGCCGTGCACGGTCGCGGTGCGACCATGGTGCA
CGCCAGTGACCTCACGCTGGACAAGTTCCTCGACGAGGCGACCCTGGCCGCCGCGCCCAGCCTGCCCAAG
CCGGCCACCGAGGTGCGCACCGTGCTGTTGACCGGCGCGACCGGCTTTTTGGGCCGCTACCTGGCGCTGG
ACTGGCTCGAGCGGATGGACATGGTCGACGGCAAGGTCATCGCCCTGGTGCGGGCCCGCACCGATGAGGA
GGCGCGCGCCCGGCTGGACAAGACCTTCGACAGCGGCGACCCCAAACTGCTGGCGCACTACCAGCGGCTG
GCCGCCGACCACCTCGAGGTCATCGCCGGCGACAAGGGTGAGGCCAACCTCGGCCTGGACCCCCAGACCT
GGCAGCGACTGGCCGAGGAGGTCGACGTCATCGTCGACCCCGCCGCGCTGGTCAACCACGTGCTGCCCTA
CAGCGAGCTGTTCGGCCCCAACGCCCTGGGCACCGCGGAGCTGATCCGGATCGCGCTGACCTCCAGGCAA
AAGCCCTACACCTACGTGTCGACGATCGGGGTGGGCGATCAGATCCAGCCAGGTGAGTTCGTCGAGAACG
CCGACATCCGCCAGATCAGCGCCACCCGCGAGATCAACGACGGCTACGCCAACGGCTACGGCAACAGCAA
GTGGGCCGGCGAGGTGTTGCTGCGCGAGGCCCACGACCTGTGCGGCCTGCCCGTCACGGTGTTCCGCTGC
GACATGATCCTGGCCGACACCACCTATGCCGGGCAGCTCAACCTGCCCGACATGTTCACCCGGCTGATGC
TGAGCCTGGTCGCCACCGGTATCGCGCCCGGGTCGTTCTACGAACTGGACGCCGACGGCAACCGCCAGCG
GGCACACTACGACGGTTTGCCGGTCGAGTTCATCGCCGCGGCGATCTCGACGCTGGGGACCCAAATCACC
GACAGCGACACGGGCTTTCAGACCTACCACGTGATGAACCCCTACGACGACGGCATCGGGCTGGATGAGT
ACATCGATTGGCTGATCGAGGCCGGGTATTCGATCGAGCGGATCGCCGATTACTCCGAGTGGCTGCGGCG
CTTCGAGACCTCGCTGCGGGCCCTGCCCGATCGGCAGCGTCAGTACTCGCTGCTGCCGCTGCTGCACAAC
TACCAGAAGCCGGAAAAGCCGATCAACGGCTCGATGGCGCCCACCGACGTGTTCCGTGCCGCGGTGCAGG
AAGCGAAAATCGGCCCCGACAAAGACATCCCGCACGTCTCGGCGCCGGTGATCGTCAAGTACATCACCGA
CCTGGAGTTGCTCGGACTCCTCTGA

Amino acid sequence (SEQ ID NO:34)

>gi|254819907|ref|ZP_05224908.1| FadD9 [Mycobacterium intracellulare ATCC 13950]

MSTAIHDEHLDRRIEELIANDPQFAAARPDPAITAATEAPGLRLPQIIRTVLDGYADRPALAQRVVEFVT
DAKTGRTTAELLPRFETITYGELGERVSALGRAWAGDAVRPGDRVCVLGFNSVDYATIDIALGTIGAVSV
PLQTSAAISSLQPIVAETEPSLIASSVNQLPDAVELILAGDHVPGKLVVFDYQPQVDDQREAVEAAAARL
ADSGVAVEALADVLRRGKDLPAVEPPASDEDSLALLIYTSGSTGAPKGAMYPQSNVGKMWRRGSKNWFGE
SAASITLNFMPMSHVMGRGILYGTLGNGGTAYFAARSDLSTLLEDLELVRPTEMNFVPRIWETLYGEFQR
QVERRLADGDAGPEARETVAAAVLEEQRQYLLGGRFIFAMTGSAPTSPELKAWAESLLQMHLMDGYGSTE
AGMVLFDGEIQRPPVIDYKLVDVPDLGYFSTDRPHPRGELLLRTENMFPGYYKRAETTANVFDEDGYYRT
GDVFAEIAPDRLVYVDRRNNVLKLAQGEFVTLAKLEAVFGNSPLIRQIYVYGNSSQPYLLAVVVPTEEAL
ADNDLESLKPKIADSLQKVAKETGLQSYEVPRDFIIETTPFTLENGLLTGIRKLAWPKLKAHYGDRLEQM
YAELAAGQANELAELRRSGAAAPVAQTVSRAAAALLGATAGDLSADAHFTDLGGDSLSALTFGNLLREIF
DVDVPVGVIVSPANDLAGIAAYIEAERQGSKRPTFAAVHGRGATMVHASDLTLDKFLDEATLAAAPSLPK
PATEVRTVLLTGATGFLGRYLALDWLERMDMVDGKVIALVRARTDEEARARLDKTFDSGDPKLLAHYQRL
AADHLEVIAGDKGEANLGLDPQTWQRLAEEVDVIVDPAALVNHVLPYSELFGPNALGTAELIRIALTSRQ

FIG. 4 (Cont.)

KPYTYVSTIGVGDQIQPGEFVENADIRQISATREINDGYANGYGNSKWAGEVLLREAHDLCGLPVTVFRC
DMILADTTYAGQLNLPDMFTRLMLSLVATGIAPGSFYELDADGNRQRAHYDGLPVEFIAAAISTLGTQIT
DSDTGFQTYHVMNPYDDGIGLDEYIDWLIEAGYSIERIADYSEWLRRFETSLRALPDRQRQYSLLPLLHN
YQKPEKPINGSMAPTDVFRAAVQEAKIGPDKDIPHVSAPVIVKYITDLELLGLL

YP 889972.1

Nucleotide sequence (SEQ ID NO:35)

>uniprot|A0R484|A0R484_MYCS2 Putative long-chain fatty-acid--CoA ligase

ATGACCAGCGATGTTCACGACGCCACAGACGGCGTCACCGAAACCGCACTCGACGACGAG
CAGTCGACCCGCCGCATCGCCGAGCTGTACGCCACCGATCCCGAGTTCGCCGCCGCCGCA
CCGTTGCCCGCCGTGGTCGACGCGGCGCACAAACCCGGGCTGCGGCTGGCAGAGATCCTG
CAGACCCTGTTCACCGGCTACGGTGACCGCCCGGCGCTGGGATACCGCGCCCGTGAACTG
GCCACCGACGAGGGCGGGCGCACCGTGACGCGTCTGCTGCCGCGGTTCGACACCCTCACC
TACGCCCAGGTGTGGTCGCGCGTGCAAGCGGTCGCCGCGGCCCTGCGCCACAACTTCGCG
CAGCCGATCTACCCCGGCGACGCCGTCGCGACGATCGGTTTCGCGAGTCCCGATTACCTG
ACGCTGGATCTCGTATGCGCCTACCTGGGCCTCGTGAGTGTTCCGCTGCAGCACAACGCA
CCGGTCAGCCGGCTCGCCCCGATCCTGGCCGAGGTCGAACCGCGGATCCTCACCGTGAGC
GCCGAATACCTCGACCTCGCAGTCGAATCCGTGCGGGACGTCAACTCGGTGTCGCAGCTC
GTGGTGTTCGACCATCACCCCGAGGTCGACGACCACCGCGACGCACTGGCCCGCGCGCGT
GAACAACTCGCCGGCAAGGGCATCGCCGTCACCACCCTGGACGCGATCGCCGACGAGGGC
GCCGGGCTGCCGGCCGAACCGATCTACACCGCCGACCATGATCAGCGCCTCGCGATGATC
CTGTACACCTCGGGTTCCACCGGCGCACCCAAGGGTGCGATGTACACCGAGGCGATGGTG
GCGCGGCTGTGGACCATGTCGTTCATCACGGGTGACCCCACGCCGGTCATCAACGTCAAC
TTCATGCCGCTCAACCACCTGGGCGGGCGCATCCCCATTTCCACCGCCGTGCAGAACGGT
GGAACCAGTTACTTCGTACCGGAATCCGACATGTCCACGCTGTTCGAGGATCTCGCGCTG
GTGCGCCCGACCGAACTCGGCCTGGTTCCGCGCGTCGCCGACATGCTCTACCAGCACCAC
CTCGCCACCGTCGACCGCCTGGTCACGCAGGGCGCCGACGAACTGACCGCCGAGAAGCAG
GCCGGTGCCGAACTGCGTGAGCAGGTGCTCGGCGGACGCGTGATCACCGGATTCGTCAGC
ACCGCACCGCTGGCCGCGGAGATGAGGGCGTTCCTCGACATCACCCTGGGCGCACACATC
GTCGACGGCTACGGGCTCACCGAGACCGGCGCCGTGACACGCGACGGTGTGATCGTGCGG
CCACCGGTGATCGACTACAAGCTGATCGACGTTCCCGAACTCGGCTACTTCAGCACCGAC
AAGCCCTACCCGCGTGGCGAACTGCTGGTCAGGTCGCAAACGCTGACTCCCGGGTACTAC
AAGCGCCCCGAGGTCACCGCGAGCGTCTTCGACCGGGACGGCTACTACCACACCGGCGAC
GTCATGGCCGAGACCGCACCCGACCACCTGGTGTACGTGGACCGTCGCAACAACGTCCTC
AAACTCGCGCAGGGCGAGTTCGTGGCGGTCGCCAACCTGGAGGCGGTGTTCTCCGGCGCG
GCGCTGGTGCGCCAGATCTTCGTGTACGGCAACAGCGAGCGCAGTTTCCTTCTGGCCGTG
GTGGTCCCGACGCCGGAGGCGCTCGAGCAGTACGATCCGGCCGCGCTCAAGGCCGCGCTG
GCCGACTCGCTGCAGCGCACCGCACGCGACGCCGAACTGCAATCCTACGAGGTGCCGGCC
GATTTCATCGTCGAGACCGAGCCGTTCAGCGCCGCCAACGGGCTGCTGTCGGGTGTCGGA
AAACTGCTGCGGCCCAACCTCAAAGACCGCTACGGGCAGCGCCTGGAGCAGATGTACGCC
GATATCGCGGCCACGCAGGCCAACCAGTTGCGCGAACTGCGGCGCGCGGCCGCCACACAA
CCGGTGATCGACACCCTCACCCAGGCCGCTGCCACGATCCTCGGCACCGGGAGCGAGGTG
GCATCCGACGCCCACTTCACCGACCTGGGCGGGGATTCCCTGTCGGCGCTGACACTTTCG
AACCTGCTGAGCGATTTCTTCGGTTTCGAAGTTCCCGTCGGCACCATCGTGAACCCGGCC
ACCAACCTCGCCCAACTCGCCCAGCACATCGAGGCGCAGCGCACCGCGGGTGACCGCAGG
CCGAGTTTCACCACCGTGCACGGCGCGGACGCCACCGAGATCCGGGCGAGTGAGCTGACC
CTGGACAAGTTCATCGACGCCGAAACGCTCCGGGCCGCACCGGGTCTGCCCAAGGTCACC
ACCGAGCCACGGACGGTGTTGCTCTCGGGCGCCAACGGCTGGCTGGGCCGGTTCCTCACG

FIG. 4 (Cont.)

TTGCAGTGGCTGGAACGCCTGGCACCTGTCGGCGGCACCCTCATCACGATCGTGCGGGGC
CGCGACGACGCCGCGGCCCGCGCACGGCTGACCCAGGCCTACGACACCGATCCCGAGTTG
TCCCGCCGCTTCGCCGAGCTGGCCGACCGCCACCTGCGGGTGGTCGCCGGTGACATCGGC
GACCCGAATCTGGGCCTCACACCCGAGATCTGGCACCGGCTCGCCGCCGAGGTCGACCTG
GTGGTGCATCCGGCAGCGCTGGTCAACCACGTGCTCCCCTACCGGCAGCTGTTCGGCCCC
AACGTCGTGGGCACGGCCGAGGTGATCAAGCTGGCCCTCACCGAACGGATCAAGCCCGTC
ACGTACCTGTCCACCGTGTCGGTGGCCATGGGGATCCCCGACTTCGAGGAGGACGGCGAC
ATCCGGACCGTGAGCCCGGTGCGCCCGCTCGACGGCGGATACGCCAACGGCTACGGCAAC
AGCAAGTGGGCCGGCGAGGTGCTGCTGCGGGAGGCCCACGATCTGTGCGGGCTGCCCGTG
GCGACGTTCCGCTCGGACATGATCCTGGCGCATCCGCGCTACCGCGGTCAGGTCAACGTG
CCAGACATGTTCACGCGACTCCTGTTGAGCCTCTTGATCACCGGCGTCGCGCCGCGGTCG
TTCTACATCGGAGACGGTGAGCGCCCGCGGGCGCACTACCCCGGCCTGACGGTCGATTTC
GTGGCCGAGGCGGTCACGACGCTCGGCGCGCAGCAGCGCGAGGGATACGTGTCCTACGAC
GTGATGAACCCGCACGACGACGGGATCTCCCTGGATGTGTTCGTGGACTGGCTGATCCGG
GCGGGCCATCCGATCGACCGGGTCGACGACTACGACGACTGGGTGCGTCGGTTCGAGACC
GCGTTGACCGCGCTTCCCGAGAAGCGCCGCGCACAGACCGTACTGCCGCTGCTGCACGCG
TTCCGCGCTCCGCAGGCACCGTTGCGCGGCGCACCCGAACCCACGGAGGTGTTCCACGCC
GCGGTGCGCACCGCGAAGGTGGGCCCGGGAGACATCCCGCACCTCGACGAGGCGCTGATC
GACAAGTACATACGCGATCTGCGTGAGTTCGGTCTGATCTGA

Amino acid sequence (SEQ ID NO:36)

>uniprot|A0R484|A0R484_MYCS2 Putative long-chain fatty-acid--CoA ligase

MTSDVHDATDGVTETALDDEQSTRRIAELYATDPEFAAAAPLPAVVDAAH
KPGLRLAEILQTLFTGYGDRPALGYRARELATDEGGRTVTRLLPRFDTLT
YAQVWSRVQAVAAALRHNFAQPIYPGDAVATIGFASPDYLTLDLVCAYLG
LVSVPLQHNAPVSRLAPILAEVEPRILTVSAEYLDLAVESVRDVNSVSQL
VVFDHHPEVDDHRDALARAREQLAGKGIAVTTLDAIADEGAGLPAEPIYT
ADHDQRLAMILYTSGSTGAPKGAMYTEAMVARLWTMSFITGDPTPVINVN
FMPLNHLGGRIPISTAVQNGGTSYFVPESDMSTLFEDLALVRPTELGLVP
RVADMLYQHHLATVDRLVTQGADELTAEKQAGAELREQVLGGRVITGFVS
TAPLAAEMRAFLDITLGAHIVDGYGLTETGAVTRDGVIVRPPVIDYKLID
VPELGYFSTDKPYPRGELLVRSQTLTPGYYKRPEVTASVFDRDGYYHTGD
VMAETAPDHLVYVDRRNNVLKLAQGEFVAVANLEAVFSGAALVRQIFVYG
NSERSFLLAVVVPTPEALEQYDPAALKAALADSLQRTARDAELQSYEVPA
DFIVETEPFSAANGLLSGVGKLLRPNLKDRYGQRLEQMYADIAATQANQL
RELRRAAATQPVIDTLTQAAATILGTGSEVASDAHFTDLGGDSLSALTLS
NLLSDFFGFEVPVGTIVNPATNLAQLAQHIEAQRTAGDRRPSFTTVHGAD
ATEIRASELTLDKFIDAETLRAAPGLPKVTTEPRTVLLSGANGWLGRFLT
LQWLERLAPVGGTLITIVRGRDDAAARARLTQAYDTDPELSRRFAELADR
HLRVVAGDIGDPNLGLTPEIWHRLAAEVDLVVHPAALVNHVLPYRQLFGP
NVVGTAEVIKLALTERIKPVTYLSTVSVAMGIPDFEEDGDIRTVSPVRPL
DGGYANGYGNSKWAGEVLLREAHDLCGLPVATFRSDMILAHPRYRGQVNV
PDMFTRLLLSLLITGVAPRSFYIGDGERPRAHYPGLTVDFVAEAVTTLGA
QQREGYVSYDVMNPHDDGISLDVFVDWLIRAGHPIDRVDDYDDWVRRFET
ALTALPEKRRAQTVLPLLHAFRAPQAPLRGAPEPTEVFHAAVRTAKVGPG
DIPHLDEALIDKYIRDLREFGLI

Nucleotide sequence (SEQ ID NO:37)

>gi|218125542:1370-4894 Mycobacterium kansasii ATCC 12478
NZ_ACBV01000156, whole genome shotgun sequence atgtcgactaccactcgtgacgagcgcctcgagcgccgcatcgacaccctgatccacgacgacgcacagtt
cgccgccgccaagccggacccggcaatcgccgccgccctggaaaagcccggcctgagcctgccagagatca
tccagaccgcgctgcagggctacgccgaccggccggctctcgggcagcgcgccgtcgagttcgtcacggac
acccagaccggccgcacctcggtgcggctgctgacccgcttcgagaccatcacctaccgtcagctcggcga
ccgggtcggtgcgctggcgcgcgccctgacccacgactcggtgcacgccggcgaccgggtctgcgtgctgg
gcttcaacagcctcgactacaccaccatcgacatggcgctggcgaaggtcggcgcggtgtcggtgccgctg
cagaccagtgcggcggttacccagctgcagccgatcgtggccgagaccgagcccaccatgatggcggccag
tgtgaatcagctgtcggatgccgtggacgtgctgttgagcggccacctgccggccaagctggtggtgttcg
actaccaccccgaggtggacgaccagcgcgaggcgctcgacacggcccgggagcggttggcggacacagcg
gtggttgtccagaccctcaaggacgtcctggaccacggcgcaacgctggcggcggggtcggttgccgagcc
gctcgcggcgtcgggcgacaacgactcgctggcgctgctgatctacacctccggcagcaccggcgcaccca
aaggtgcgatgtatcgacagagcaacgtcggcaagatgtggcgccggtcgagcaagaactggttcgggccc
accgcggcgtcgatcaccctcaacttcatgccgatgagccacatcatgggacgtggagtcctctacggcac
gctcggcaacggcggcaccgcgtacttcgcggccaggagcgacctctcgacgctgctggaagacttgcggc
tggtgcggcccaccgagttgaacttcgtgccgcggatctgggagaccttgtacggcgaataccagcgcgcg
gtcgaccagcggtcggtcgatcccggtgaacccgccgcccgcgaagccgtcgaagcccaggtcatggccga
gcagcgccaggacctgctgggtggcgctatatcttcgcgatgacgggctcggcgcccatgtccccggagc
tgcggaactgggtggaagcgctgctggagatcccactgctcgacggttacggctccaccgaggccgggatg
gtcatgttcgacggtgaaattcagcgcccgccggtgatcgactacaagctggtcgacgtgcccgatctggg
ctacttcagcaccgaccagccgtatccgcggggcgagttgctgctcaagaccgagaacatgttcccaggct
attacaagcggccggaggttacggccagcgtgttcgacgcggacggctactaccggaccggagacgtcgtg
gccgaggtcgctccggaccggctggtgtacgtggaccgccgcaacaacgtgctgaagcttgcccagggcga
gttcgtgaccgtcgccaagctggaggcggtgttcggcaacagcccgctggtgcgccagatctacgtctacg
gcaacagcgcgcatccctacctgttggccgtggtggtgccaacggaagaagcgtcggcgggcactgacata
gcggccttgaagccgctgatcgccgactcgctgcagaccgtcgccaaagaggccggcctgcagtcctacga
ggtgccgcgcgacttcctcatcgagacaacaccattcacgctggagaacggtctgctcaccggtatccgca
agctggcgtggccgaagctgaggcagcattacggcgaacggctggagcagctctacacggagctggccgcg
agccaggccaacgagttgagcgagctgcggcgcagcggggcccatgcgccggtgctggaaacggtgagccg
ggcggcgggcgcgctgctgggggcggcgagcaccgccttgtcacccgacgcgcacttcaccgatctgggtg
gagactcgttgtcggcgttgacattcggcaacctgctgcgggagatcttcgacgttgacgtaccggtgggt
gtgatcgtcagcccggccagcgacctggcggcgatcgccgcttacatcgagggcgagcggcagggcagcaa
gcgacccacgttcgccgtgattcacggtcgggacgcgctagaggtgcatgcgagtgacctcaccctggaca
agttcatcgacgcatccaccctggcagccgcaccggtactgccgcctccgagcgccgcggtgcgcaccgtc
ctgttgaccggcgcgaccggcttttgggccgctacctggcgctggactggctggagcgcatggacctggt
cgacggcaaggtgatcgccctggtgcgggcgaagtcggacgacgatgcccgggcacgcctggacaagacgt
tcgacagcggagaccccgagctgctgacccactaccggcggctggcgaccgaccacttggaggtcatcgcc
ggcgacaagggcgaggccaacctcgggctggatcagctgacctggcagcggctggccgacaccgtcgacct
gatcgtcgacccggccgcgttggtcaaccacgtgctgccctacagcgagctgttcggccccaacgcgctgg
gcaccgccgaattgatccggatagcgctgaccggcaagctcaagccctacacctacgtctcgaccatcggg
gtgggcgaccagatcgagccgggcaagttcaccgaggacgccgacatccggcacatcagcgcgacccggaa
gatcaacgacagttacgccaacggctacggcaacagcaagtgggccggcgaggtgctactgcgcgaggccc
acgacctgtgcgggctgccggtcgcggtgttccgctgcgacatgatcctggccgacaccacgtgggcgggt
cagctcaacgtgccggacatgttcacccggatgatgctgagcctggtggccaccggcattgcacccggttc
gttctacgagctggacgccgacggcaaccggcagcgtgcccactacgacggcttgccggtcgagttcatcg

FIG. 4 (Cont.)

ccgaggcgatcgcgacgctgggcgcccgggacgggaagggtttccagacctaccacgtgatgaacccctac
gacgacggcatcgggatggaccggttcgtcgactggctcgtcgacgccggatgcgccatccaccgcatcga
cgactacggcgactggctgcgacgattcgagaccgcgctgcgcggcctgcccgaaaagcagcgtcacgcgt
cactactgccgttgctgcacaactaccagaagccggcgccgccgctgcgcgggtcgatggctccgaccgac
cggttccgggcggccgtgcaggacgcgaaagtgggcccggacaaggacatcccgcacatctcgccgcagat
catcgcgaagtacctcagtgatctgcgcttgctcgggctcctctga

Amino acid sequence (SEQ ID NO:38)

>gi|240173202|ref|ZP_04751860.1| FadD9 [Mycobacterium kansasii ATCC 12478]
MSTTTRDERLERRIDTLIHDDAQFAAAKPDPAIAAALEKPGLSLPEIIQTALQGYADRPALGQRAVEFVT
DTQTGRTSVRLLTRFETITYRQLGDRVGALARALTHDSVHAGDRVCVLGFNSLDYTTIDMALAKVGAVSV
PLQTSAAVTQLQPIVAETEPTMMAASVNQLSDAVDVLLSGHLPAKLVVFDYHPEVDDQREALDTARERLA
DTAVVVQTLKDVLDHGATLAAGSVAEPLAASGDNDSLALLIYTSGSTGAPKGAMYRQSNVGKMWRRSSKN
WFGPTAASITLNFMPMSHIMGRGVLYGTLGNGGTAYFAARSDLSTLLEDLRLVRPTELNFVPRIWETLYG
EYQRAVDQRSVDPGEPAAREAVEAQVMAEQRQDLLGGRYIFAMTGSAPMSPELRNWVEALLEIPLLDGYG
STEAGMVMFDGEIQRPPVIDYKLVDVPDLGYFSTDQPYPRGELLLKTENMFPGYYKRPEVTASVFDADGY
YRTGDVVAEVAPDRLVYVDRRNNVLKLAQGEFVTVAKLEAVFGNSPLVRQIYVYGNSAHPYLLAVVVPTE
EASAGTDIAALKPLIADSLQTVAKEAGLQSYEVPRDFLIETTPFTLENGLLTGIRKLAWPKLRQHYGERL
EQLYTELAASQANELSELRRSGAHAPVLETVSRAAGALLGAASTALSPDAHFTDLGGDSLSALTFGNLLR
EIFDVDVPVGVIVSPASDLAAIAAYIEGERQGSKRPTFAVIHGRDALEVHASDLTLDKFIDASTLAAAPV
LPPPSAAVRTVLLTGATGFLGRYLALDWLERMDLVDGKVIALVRAKSDDDARARLDKTFDSGDPELLTHY
RRLATDHLEVIAGDKGEANLGLDQLTWQRLADTVDLIVDPAALVNHVLPYSELFGPNALGTAELIRIALT
GKLKPYTYVSTIGVGDQIEPGKFTEDADIRHISATRKINDSYANGYGNSKWAGEVLLREAHDLCGLPVAV
FRCDMILADTTWAGQLNVPDMFTRMMLSLVATGIAPGSFYELDADGNRQRAHYDGLPVEFIAEAIATLGA
RDGKGFQTYHVMNPYDDGIGMDRFVDWLVDAGCAIHRIDDYGDWLRRFETALRGLPEKQRHASLLPLLHN
YQKPAPPLRGSMAPTDRFRAAVQDAKVGPDKDIPHISPQIIAKYLSDLRLLGLL

YP 978699.1

Nucleotide sequence (SEQ ID NO:39)

>uniprot|A1KLT8|A1KLT8_MYCBP Probable fatty-acid-CoA ligase fadD9

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG

FIG. 4 (Cont.)

ATCACGCTGAACTTCATGCCGATGAGCCACGTCGGGGGCCGTCAGGTGCTCTACGGGACG
CTTTCCAACGGCGGTACCGCCTACTACGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCCTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCCGCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA

Amino acid sequence (SEQ ID NO:40)

>uniprot|A1KLT8|A1KLT8_MYCBP Probable fatty-acid-CoA ligase fadD9

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL

FIG. 4 (Cont.)

RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYYVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

ZP_05227804

Nucleotide sequence (SEQ ID NO:41)

>gi|163719878:4480-7968 Mycobacterium intracellulare ATCC 13950
NZ_ABIN01000296, whole genome shotgun sequence TTGGCCGCGACCGACGAACAGTTCCGCAACGCCCAACCCGATCTGTCGCTGCAGCAGGCGGCGCGCCAAC
CGGGCCTGCGCCTGCCCCAGATTCTGGAGCTGTTCGTCGAGGGCTACGCCGATCGGCCCGCGGTGGGCTG
GCGGGCCAGGACACTGAGCACCGACCCCGCGACCGGGCGTACCACCACGCGACTGCTCCCCCGCTTCGAC
ACCATGACCTACCGCGAGCTGTGGGCCGATGTGCGCGCGATCGCCGCCGCGTGGCGGCACGACGCCGCGA
ACCCCGTGTCGCCCGGGGACTTCGTCGCGACGGTCGGTTTCGCCAGCGCCGAATATCTGACCCTCGACCT
GGTCTGCGGCTACCTCGGGCTGGTTGCCGTTCCGCTGCAACACAATACGACCCCCTCACGGCTGCGACCG
ATCGTCGACGAGGTCGAGCCGTCGATACTGGCCGCCGGCGTCGGTTATCTCGACCTCGCGGTCGAGGCGG
CGTCGGGCAGCTCGTCGTTGCGGCGGCTCGTGGTCTTCGATTACCAGCCCGAGGTCGACGAGCAACGCGA
GGCGCTGCAGCGCGCCCAGGCGACGCTGGCGGCCGCCGGCGCGGCGGTGACCATCGAGACCCTCGACGAA
ATCATCGAACGCGGACGCGCCCTGCCGCCCGAGCCCATGTACACCGGTGATACCGATCAGCGGCTGGCGA
TGATCATGTACACCTCGGGCAGCACCGGGTTACCCAAGGGCGCCATGTACACCGAGCAGATGCTGGCCAA
GGTGTGGACCAACGAGCTGATGCCCGACTTCGCGGACACACCCGTGTTCAACGTCAACTTCATGCCGCTG
AATCACCTCGGTGGCCGGATACCGCTGTCGACCGCGTTCCAGGCCGGCGGCACCAGCTATTTCGTGCCGG
AAAGCGACCTGTCCACGTTGTTCGACGACTGGAACCTGGTGCGCCCCACCGAGATGGGCCTGGTACCCCG
GGTGGCGGAAATGCTCTACCAGCGCTACCAGAGCGCCGTCGACCGACTCGTGGCTTCGGGCGCCGACGCC
GGCTCCGCCGAGGCCCGGGCGCGGGCCGAGCTGCGTGAGCATGTCCTCGGCGGGCGCATCGTGACCGCCT
TCTGCGGGACGGCGCCGCTGGCCGCGGAGATGCGGGCCTTCGTCGAAACCTGTTTGGACGTCCACGTTCT
CGACGGCTACGGGCTGACCGAGGTCGGCATGGTGACCAAGGACGGGCGCATGACCCGTCCCCCGGTGCTC
GACTACAAGCTCATCGACGTTCCCGAACTCGGCTATTTCCACACCGACAAGCCTTATCCGCGTGGCGAAT
TGCTGGTGAAGTCGCTGACCGCGACGCCGGGCTACTTCAAACGACCGGACGTCACCGCCAACGCGTTCGA
TCCCGACGGCTACTACCGGACCGGCGATGTGATGGCCGAGCTCGAGCCGGACCGGCTGGCCTACGTCGAC
CGCCGCAACAACGTGTTGAAGTTGGCGCAGGGCGAGTTCGTCGCCGTCGCCCGCCTGGAGGCCGTCTTCG
CCAGCGCGCCGCTGATCCGCCAGATCTTCGTATACGGCAACAGCGAACGCCCCTATCTGCTGGCCGTCGT
CGTGCCGACGGCCGACGCCGCGGAGCGATTCACCGGAGATCCCGAGGGCCTCAAGGCCGCCGTCGCCGAA

FIG. 4 (Cont.)

TCCCTGCGCCAGTCGGCGCAACTCGCCGAACTGCAGTCCTACGAGGTGCCCGTCGACTTCGTCGTCGAGA
CCGAGCCGTTCAGCGAGGACAACGGCCTGCTCTCGGGCGTGGGCAAGCTGCTGCGGCCGAAGCTCAAGGA
GCGCTACGCCGACCGGCTCGAACAGCTCTACGCCGAGCTGGCCGAAAACCGCGTGACCGAGTTGCGTGCG
CTGCGCGAGGGGGCGGACAAACACCCCGTCGTCTTCACCCTCACCCGGGCCGCCGAGGCGCTACTGGGTG
TGGCCGGCGGCCCGCCCGCCCCCGACGCACTGTTCATCGAACTCGGCGGCGATTCCCTGTCGGCGCTGAC
CTTCTCCAACCTGCTGCGCGACATCTTCGACGTCGACGTGCCGGTGGGAATGATCACCGGGCCCGCGACC
GACCTGGGCCAGCTCGCGGAATACGTTGAATCCGAACGCAAATCGGGATCACGCCGGCCCACATTCGCGA
CGGTGCACGGACGCGGCGCCGCCGAGGTCCGCGCCGCGGAGCTCACCCTCGACAAGTTCATCGACGCGAC
GACCTTGGCCGCCGCACCGAACCTGCCGCGCGCGACCGGCACACCCCACACGGTCCTGCTGACCGGCGCC
AACGGCTACCTCGGCCGCTTCCTGGCCCTCGAATGGCTCGAGCGCCTCGCCGAGACCGGCGGGAAGCTCG
TCTCCATCGTCCGCGCGACGGACACCGCGGCGGCCGTCAAACGGCTGGAGGCCGTTTTCGACAGCGGGGA
TCCGCAGTTGCTGGAGCGGTTCCGGACGCTGGCCGCCGAGCACCTGGAAGTCATCGTCGGCGACATCGGT
GAGCCCAATCTCGGCCTGGACCAAGCGACTTGGCAGCGCCTGGCCCAGAGCGTGGATCTGATCGTCCACC
CGGCCGCGTTGGTCAACCACGTGCTGCCGTACGACCAACTGTTCGGTCCGAACGTCGTCGGCACCGCCGA
GTTGATCCGCCTGGCGATCACGACGCGCATCAAGCCCGTCACCTATCTGTCGACCGTCGCCGTGGCGATG
ACGGTCGATCCCGGCGAGTTCGCCGAAGACGGCGACATCCGCGCGGTCAGCGCGGTACGCCCGATCGACG
ACAGCTACGCGAACGGGTACGCGAACAGCAAGTGGGCCGGTGAGGTGTTGCTGCGTGAGGCGCACGACCT
GTGCGGGTTGCCGGTCGCCGTCTTCCGCTCCGACATGATCCTCGCGCACAGCCGGTATGCCGGGCAGCTG
AACGTGCCAGATGCCTTCACCCGCTTGATGTTCAGCCTGCTGACCACCGGCATCGCGCCGACCACGTTCT
ACCGGACCGACGAACACGGAAACCGAGCCGTGGCCCACTACGACGGGCTGCCCGCCGACTTCGTGGCCGA
AGCGGTCACCACGCTCGGCGAACAGATGGCGGCCGAGGAATCCGGCGGGTACCGCTCCTATGACGTGATG
AACCCACACGACGACGGCGTCTCCCTGGACGTGTTCGTCGACTGGCTGATCGCCGCCGGACACGACATCC
GGCGCATCGAGGACTATGACGAATGGCTGGGCCGCTTCACCACGGCGCTTCGCGCGTTACCGGACAAGCA
GCGCCAGCATTCGGTGTTGCCGCTGCTGGACGCCTACCGGGAACCCGCGACGCCACTGCGGGGAGCGCCG
GCCCCCACCGACGTCTTCCGCCACGCGGTGCGGACGGCCAAAATCGGTGCGGACGAGGACATTCCGCACC
TGTCGGCGGCGTTGATCGACAAGTACGTCGCCGACCTACGCCTGCTGGGCTTGGTGTAG

Amino acid sequence (SEQ ID NO:42)

>gi|254822803|ref|ZP_05227804.1| putative long-chain fatty-acid--CoA ligase [Mycobacterium intracellulare ATCC 13950]

MAATDEQFRNAQPDLSLQQAARQPGLRLPQILELFVEGYADRPAVGWRARTLSTDPATGRTTTRLLPRFD
TMTYRELWADVRAIAAAWRHDAANPVSPGDFVATVGFASAEYLTLDLVCGYLGLVAVPLQHNTTPSRLRP
IVDEVEPSILAAGVGYLDLAVEAASGSSSLRRLVVFDYQPEVDEQREALQRAQATLAAAGAAVTIETLDE
IIERGRALPPEPMYTGDTDQRLAMIMYTSGSTGLPKGAMYTEQMLAKVWTNELMPDFADTPVFNVNFMPL
NHLGGRIPLSTAFQAGGTSYFVPESDLSTLFDDWNLVRPTEMGLVPRVAEMLYQRYQSAVDRLVASGADA
GSAEARARAELREHVLGGRIVTAFCGTAPLAAEMRAFVETCLDVHVLDGYGLTEVGMVTKDGRMTRPPVL
DYKLIDVPELGYFHTDKPYPRGELLVKSLTATPGYFKRPDVTANAFDPDGYYRTGDVMAELEPDRLAYVD
RRNNVLKLAQGEFVAVARLEAVFASAPLIRQIFVYGNSERPYLLAVVVPTADAAERFTGDPEGLKAAVAE
SLRQSAQLAELQSYEVPVDFVVETEPFSEDNGLLSGVGKLLRPKLKERYADRLEQLYAELAENRVTELRA
LREGADKHPVVFTLTRAAEALLGVAGGPPAPDALFIELGGDSLSALTFSNLLRDIFDVDVPVGMITGPAT
DLGQLAEYVESERKSGSRRPTFATVHGRGAAEVRAAELTLDKFIDATTLAAAPNLPRATGTPHTVLLTGA
NGYLGRFLALEWLERLAETGGKLVSIVRATDTAAAVKRLEAVFDSGDPQLLERFRTLAAEHLEVIVGDIG
EPNLGLDQATWQRLAQSVDLIVHPAALVNHVLPYDQLFGPNVVGTAELIRLAITTRIKPVTYLSTVAVAM
TVDPGEFAEDGDIRAVSAVRPIDDSYANGYANSKWAGEVLLREAHDLCGLPVAVFRSDMILAHSRYAGQL
NVPDAFTRLMFSLLTTGIAPTTFYRTDEHGNRAVAHYDGLPADFVAEAVTTLGEQMAAEESGGYRSYDVM
NPHDDGVSLDVFVDWLIAAGHDIRRIEDYDEWLGRFTTALRALPDKQRQHSVLPLLDAYREPATPLRGAP
APTDVFRHAVRTAKIGADEDIPHLSAALIDKYVADLRLLGLV

Nucleotide sequence (SEQ ID NO:43)

>uniprot|A1QUM2|A1QUM2_MYCTF Fatty-acid-CoA ligase fadD9

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACG
CTTTCCAACGGCGGTACCGCCTACTTCGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCCTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC

FIG. 4 (Cont.)

GGCAAGCGCAAGCCATACATCTACACCTCGACGATCGCCGTGGGCGAGCAGATCCCGCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA

Amino acid sequence (SEQ ID NO:44)

>uniprot|A1QUM2|A1QUM2_MYCTF Fatty-acid-CoA ligase fadD9

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

YP 953393.1

Nucleotide sequence (SEQ ID NO:45)

>uniprot|A1T887|A1T887_MYCVP Thioester reductase domain

ATGTCTACTGATACCCGCGAAGACCGCCTTGCCCGCCGCATCGCCGATCTGTACGCCACC
GACCCGCAGTTTGCCGCCGCAGCACCCGACGACGCCATCTCCCACGCCATCGATCAACCA

FIG. 4 (Cont.)

GGGACGCACCTGCCCGTCATCGTGCAGACCGTCCTCGACGGATACGCCGAGCGGCCCGCG
CTCGGACAGCGCGCGGTCCGTTTCGTCACCGACCCCGCCACGGGCAGAACCACCACCGAG
CTGCTCCCCCGCTTCGAGACCATCACCTACGCCGAGTTGTCACGCCGCATCCACGCGGTC
ACCGCCGCGCTGACCGATGTGCATCCGGGCGACCGCGTGGCGGTGCTGGGCTTCACCAGC
ATCGACTACACCACCGTCGACATGGCTTTGGCGATGCTGGGCGCGGTGGCGGTACCACTT
CAGACCAGCGCGCCGGCCACCACCGTCCGGCCGATCGTCGCCGAGACCGAACCGGTGGTC
ATCGCATCGTCGGTCGATGCCCTCACCGACGCCGTCGGCCTGGCTCTCGACGCTCCCACC
GTGACCCGCCTTGTGGTCTTCGATCATCGCGCCGGGGTCGACGATCATCGCGACGCCCTC
ATCTCCGCGAGCGACCGGTTGCGCGCCGCCAACTCGCCGATCGAGGTCGAGACCATTACC
GACATCGTCGCTCGGGGTTCGAAACTGCCTGTACGCGCGCAATTCTCGGCCGACGGTGAC
GCGCTGAGCCTGCTGATCTACACCTCCGGCAGCACCGGCGCACCCAAGGGTGCGATGTAC
CCCCAACACCTGGTCGCCAACTCATGGCGGCGGTTGGCCCGGTCCTTCTGGGGCGACCTG
GGGGTCTTCCCGGCAATCACGCTGAACTTCATGCCGATGAGCCACGTGATGGGCCGCGGA
CTGCTCTACGGCACGCTGGACGCCGGCGGCACCGCGTATTTCGCGGCCAGGAGCGATCTG
TCGACGTTCCTGGAGGATCTCGCCCTGGTGCGCCCGACGCAGCTGAGCTTCGTGCCGCGG
ATCTGGGACACCATCCACGCCGAGGTGTCCCAGGAACTCGAGCGCCGGCCGTCGGATGCG
ACCGAGGTGATCGCCGATCTGCGGCGGAGCCTGCTGGGCGGCCGCTACGTCACGGCGATG
ACGGGCTCCGCGCCGCTGTCACCGGAGATGCGGGCCTTCGTCGAGAACCTGCTCGACGTG
CACCTGATCGACGGGTACGGCTCGACCGAGGCCGGCGCGGTGTTCGTCGACGGCCGGGTC
CAACGCCCGCCGGTCATCGATTACAAGCTCGTCGACGTCGCCGACCTCGGCTACTTCTCC
ACCGACCGCCCCCATCCGCGCGGCGAGCTTCTCGTCAAATCCGAGACGCTGTTTCCCGGC
TACTACAAACGCCCCGACGTCACCGCCGAGATGTTCGACGAAGACGGCTACTACCGCACC
GGCGACATCGTCGCCGAGACCGGGGCCGACCAGCTGACCTATCTGGACCGCCGCAACAAC
GTCCTCAAACTGTCGCAGGGCGAATTCGTCACCGTCTCCCGACTGGAGGCAGTGTTCGGC
AACAGCCCGCTGGTCCGCCAGATCTACGTCTACGGCAACAGCGCCCGCCCCTACCTGCTG
GCTGTGGTCGTGCCCACCGAAGCCGCGCTGGCCGGTGCTGACGCCAAAGCCGCTGTGGCC
GAGTCACTTCAGGATGTCGCCAAGGCGACCGGGCTGCAGTCCTACGAGATCCCCCGCGAT
TTCCTTCTCGAGACGACGCCGTTCACGCTGGAGAACGGCTTGCTGACCGGCATCCGAAAA
CTGGCCCGCCCCAGACTCAGAGAGCGTTACGGCGAACAGCTCGAGGCCCTCTACACCATG
CTGTCCGAAGAGCAGGCCGACGAGCTGCGGGAGCTGCGCCGCTCCGGCGGAGAGCGTCCG
GCGCTGGAAACCGTCGGACGCGCCGCCGGGGCGCTGCTCGGCACCACCGCAGGCGAGCTG
GAGCCGAGCGCCCACTTCACAGATCTGGGCGGGGATTCGCTGTCGGCGTTGACCTTCGCC
AACCTGCTGCGCGACATCTTCGACGTCGACGTCCCCGTCGGTGTGATCGTCAGCCCGGCC
ACCGATCTGCAGGCCCTTGCCGACTACGTCGAGTCCGCCCGCCGGCACGGGTCGGTGCGG
CCCACTTTCGAATCGGTGCACGGGCATTCGGGACGACCCGGGACCGAGGTGCATGCCCGC
GATCTGACGTTGGACGAATTCGTCGACGCCGCGACCCTGGCGCACGCGCCGACGTTGCCC
GGACCGCGCGCCGAGGTCCGCACCGTCCTGCTGACCGGGGCGACCGGCTTCCTCGGCCGG
TATCTCGCTCTCGAATGGCTTGAGCGGATGGCGCTGGTCGGCGGCAAGCTGATCTGCCTG
GTCCGCGCCAAAGACGATGCGGCAGCGCGGGTTCGGCTGGACAGCACGTTCGACAGCGGG
GACCCGGAGCTGCTGCGGCACTACCGACGGCTGGCAGCCGACCATCTCGAAGTGATCGCC
GGCGACAAGGCCGACGCCGATCTCGGACTCGACGCGCGGACGTGGCAGCGGCTCGCGGAC
ACCGTCGATCTGATCGTCGATCCCGCCGCCCTGGTCAACCACGTCCTGCCGTACCGCCAA
CTGTTCGCCCCGAACGTGCTCGGCACCGCCGAACTGCTCCGCATCGCGCTGACAACGAGG
ATGAAGCCGTTCGTGTACGTGTCGACGATCGGCGTCGGCGCCGGTATCGAACCCGCGAGG
TTCACCGAGGACGCCGACATCAGGCAGATCAGCGCGACGCGCAGAATCGACGACAGCTAC
GCCAACGGCTACGGCAACAGCAAGTGGGCCGGCGAGGTGCTGCTGCGCGAGGCGCACGAT
CTGTGCGGCCTGCCCGTTTCGGTGTTCCGCTGCGACATGATCCTGGCCGACACCACCTAC
GCCGGTCAGCTGAACCTGCCGGACATGTTCACCCGCCTGATCTTCAGCCTGGTCGCCACC
GGCGTCGCGCCCGAGTCGTTCTACCACCTCGCCACCGACGGCACCCGGCAACGGGCCCAC
TATGACGGGCTACCGGTGGAGTTCATCGCCGAAGCGATCTCGACCCTCGGCTCTGACGTC
GCCTCCGGGTTCCGGACGTATCACGTGATGAATCCCCACGACGACGGGATAGGCCTCGAC
GAGTACGTGGACTGGCTCATCGACGCAGGCCATCCGATTCGACGCGTCGGCGACTACCCG
ACGTGGCTGCAACGGTTCACGGTGGCGATCACCGCGCTGCCGGAACGGCAGCGGCAGGCC
TCACTGTTGCCGCTGCTGCACAACTACCAGCACCCGGAGACGCCGATCCGCGGCTCCATC

FIG. 4 (Cont.)

GCACCGACAGACAGATTCCGTGAAGCGGTCCAGGACGCCAAAATCGGTCCGGACAAAGAC
ATTCCACACGTGACACCGCAGATCGTCATCAAGTACGTCACCGACCTGCAGCGACTCGGA
CTGCTCTAA

Amino acid sequence (SEQ ID NO:46)

>uniprot|A1T887|A1T887_MYCVP Thioester reductase domain

MSTDTREDRLARRIADLYATDPQFAAAAPDDAISHAIDQPGTHLPVIVQT
VLDGYAERPALGQRAVRFVTDPATGRTTTELLPRFETITYAELSRRIHAV
TAALTDVHPGDRVAVLGFTSIDYTTVDMALAMLGAVAVPLQTSAPATTVR
PIVAETEPVVIASSVDALTDAVGLALDAPTVTRLVVFDHRAGVDDHRDAL
ISASDRLRAANSPIEVETITDIVARGSKLPVRAQFSADGDALSLLIYTSG
STGAPKGAMYPQHLVANSWRRLARSFWGDLGVFPAITLNFMPMSHVMGRG
LLYGTLDAGGTAYFAARSDLSTFLEDLALVRPTQLSFVPRIWDTIHAEVS
QELERRPSDATEVIADLRRSLLGGRYVTAMTGSAPLSPEMRAFVENLLDV
HLIDGYGSTEAGAVFVDGRVQRPPVIDYKLVDVADLGYFSTDRPHPRGEL
LVKSETLFPGYYKRPDVTAEMFDEDGYYRTGDIVAETGADQLTYLDRRNN
VLKLSQGEFVTVSRLEAVFGNSPLVRQIYVYGNSARPYLLAVVVPTEAAL
AGADAKAAVAESLQDVAKATGLQSYEIPRDFLLETTPFTLENGLLTGIRK
LARPRLRERYGEQLEALYTMLSEEQADELRELRRSGGERPALETVGRAAG
ALLGTTAGELEPSAHFTDLGGDSLSALTFANLLRDIFDVDVPVGVIVSPA
TDLQALADYVESARRHGSVRPTFESVHGHSGRPGTEVHARDLTLDEFVDA
ATLAHAPTLPGPRAEVRTVLLTGATGFLGRYLALEWLERMALVGGKLICL
VRAKDDAAARVRLDSTFDSGDPELLRHYRRLAADHLEVIAGDKADADLGL
DARTWQRLADTVDLIVDPAALVNHVLPYRQLFAPNVLGTAELLRIALTTR
MKPFVYVSTIGVGAGIEPARFTEDADIRQISATRRIDDSYANGYGNSKWA
GEVLLREAHDLCGLPVSVFRCDMILADTTYAGQLNLPDMFTRLIFSLVAT
GVAPESFYHLATDGTRQRAHYDGLPVEFIAEAISTLGSDVASGFRTYHVM
NPHDDGIGLDEYVDWLIDAGHPIRRVGDYPTWLQRFTVAITALPERQRQA
SLLPLLHNYQHPETPIRGSIAPTDRFREAVQDAKIGPDKDIPHVTPQIVI
KYVTDLQRLGLL

<u>YP 938306.1</u>

Nucleotide sequence (SEQ ID NO:47)

>uniprot|A1UFA8|A1UFA8_MYCSK Thioester reductase domain

ATGTCCACCGAGACCCGTGAAGCGCGCCTGCAGCAGCGCATCGCGCATCTGTTCACCACC
GACCCGCAGTTCGCCGCCGCCCGGCCCGACCCCCGGATCAGCGATGCCGTCGACCGCGAT
GACACGCGGCTGACCGCCATCGTCTCCGCGGTCATGTCGGGGTACGCCGACCGGCCGGCA
CTCGGGCAGCGCGCCGCCGAATTCGTCACCGACCCGCAGACCGGCCGCACCACGATGGAG
CTGCTCCCCCGCTTCGACACCATCACCTACCGGGAGCTGCTCGACCGCGTCCGGGCGCTC
ACCAACGCGTGGCACGCCGACGGGGTGCGCCCCGGCGACCGTGTCGCAATCCTCGGATTC
ACCGGCATCGACTACACCGTGGTCGACCTCGCCCTGATCCAGCTCGGCGCGGTCGCGGTG
CCGCTGCAGACCAGCGCCGCCGTGGAGGCGTTGCGCCCGATCGTGGCCGAGACCGAACCG
ATGCTCATCGCCACCGGCGTCGATCATGTCGACGCCGCCGCGGAACTCGCACTCACCGGC
CACCGTCCGTCCCGGGTGGTGGTCTTCGACCACCGCGAGCAGGTCGACGACGAACGCGAC
GCGGTGCGGGCCGCGACGGCCAGGCTGGGAGACGCCGTCCCCGTCGAGACACTCGCCGAG
GTGTTGCGGCGGGGCGCCCATCTGCCCGCCGTGGCGCCGCACGTGTTCGACGAGGCCGAT
CCACTGCGGCTGCTGATCTACACTTCCGGCAGCGCCGGCGCCCCCAAGGGCGCGATGTAT

FIG. 4 (Cont.)

CCCGAGAGCAAGGTCGCCGGCATGTGGCGCGCGTCGGCCAAGGCCGCCTGGAACAACGAT
CAGACAGCGATTCCGTCGATCACCCTGAACTTCCTGCCGATGAGCCACGTCATGGGTCGC
GGCCTGCTGTGCGGCACGCTCAGCACCGGTGGCACCGCGTATTTCGCCGCCCGCAGCGAT
CTGTCGACGCTGCTCGAGGACCTGCGCCTGGTACGGCCCACCCAACTCAGCTTCGTGCCG
CGGATCTGGGACATGCTCTTCCAGGAGTTCGTCGGCGAGGTCGACCGGCGGGTGAACGAC
GGTGCGGACCGCCCCACCGCGGAGGCCGACGTGCTGGCCGTACAGCGTCACGAGCTGCTC
GGTGGCCGGTTCGTCACCGCGATGACCGGTTCGGCGCCCATCTCCCTCGAGATGAAGACA
TGGGTGGAGACCCTGCTCGACATGCACCTGGTCGAGGGTTACGGCTCGACGGAGGCCGGC
GCGGTGTTCGTCGACGGCCACATCCAGCGCCCACCGGTGCTCGACTACAAACTCGTCGAC
GTCCCCGACCTCGGCTACTTCAGCACCGACCGGCCGCACCCGCGCGGTGAGCTGCTGGTC
CGCTCCACGCAGCTATTCCCCGGCTACTACAAACGTCCCGACGTCACCGCCGAGGTGTTC
GACGACGACGGCTTCTACCGCACGGGCGACATCGTCGCCGAGGTCGGCCCCGATCAGGTG
CAGTACCTCGACCGCCGCAACAACGTGCTCAAACTCGCCCAGGGTGAGTTCGTCACCATC
TCCAAACTCGAGGCGGTCTTCGCCGGCAGCGCCCTGGTCCGCCAGATCTACGTGTACGGC
AACAGTGCGCGCTCCTACCTGCTGGCCGTCGTCGTGCCGACCGACGATGCGGTGGCCCGG
CACGACCCGGCATCGCTCAAGACCGCGATCAGCGCCTCGCTGCAGCAGGCCGCGAAGACC
GCCGGTCTGCAGTCCTACGAGCTGCCGCGTGACTTCCTCGTCGAGACTCAACCGTTCACG
CTGGAGAACGGACTACTGACCGGCATCCGCAAGCTGGCGCGCCCGAAACTCAAGGCGCGC
TACGGCGATCGGCTCGAGGCGCTCTACGTCGAACTGGTCGAAGGACAGGCAGGCGAATTG
CGCACCCTGCGCCGGGACGGCGCGAAGCGTCCGGTGGCCGAGACGGTCGGCCGCGCCGCG
GCCGCGCTGCTCGGCGCCGCCGCCGCCGACGTGCGCCCCGACGCGCACTTCACCGACCTC
GGCGGAGACTCGTTGTCGGCGTTGACCTTCGGCAATCTGCTGCAGGAGATCTTCGGCGTC
GACGTCCCGGTCGGGGTGATCGTCAGCCCGGCGGCCGACCTGGCGTCGATCGCGGCGTAC
ATCGAGGCCGAACAGGCCTCGACCGGTAAGCGGCCGACCTACGCGTCGGTGCACGGGCGC
GACGCCGAACAGGTACACGCGCGCGACCTCACCCTGGACAAGTTCATCGACGCCGAAACA
CTCTCCGCTGCAACAGAACTGCCCGGCCCGAGCGGTGAGGTGCGCACCGTGCTGCTGACC
GGGGCCACCGGATTCCTCGGCCGCTACCTGGCGCTGGACTGGCTCGAACGGATGGCCCTG
GTCGACGGCAAGGTCATCTGCCTGGTCCGCGCGAAGGACGATGCGGCCGCCCGCAAACGC
CTCGACGACACCTTCGACAGCGGCGATCCGAAGCTGCTGGCGCACTACCGCAAGCTGGCC
GCCGACCACCTCGAAGTGCTGGCCGGCGACAAGGGTGAGGCGGATCTCGGGCTGCCGCAT
CCTGTCTGGCAGCGCCTGGCCGACACCGTCGACCTCATCGTCGACCCGGCCGCCCTGGTC
AACCACGTACTGCCGTACAGCCAGCTGTTCGGGCCCAACGCGCTGGGCACTGCCGAGCTG
ATCCGGCTTGCGCTCACCACCCGCATCAAACCGTTCACCTACGTGTCGACGATCGGCGTC
GGCGCCGGTATCGAACCGGGCCGTTTCACCGAGGACGACGACATCCGGGTGATCAGCCCG
ACGCGGGCCGTCGACACCGGGTACGCCAACGGCTACGGCAACAGCAAGTGGGCCGGTGAG
GTGTTGTTGCGCGAGGCGCACGATCTGTGCGGGCTCCCCGTGGCGGTGTTCCGGTGCGAC
ATGATCCTGGCCGACACCACCTACGCCGGCCAGCTCAACCTGCCGGACATGTTCACCCGG
ATGATGCTGAGCCTGGTGACCACGGGTATCGCGCCGAAATCGTTCCACCCACTCGACGCA
AAGGGCCACCGGCAGAGCGCCCACTACGACGGGCTGCCGGTCGAGTTCGTCGCCGAATCG
ATCTCCGCGCTGGGAGCGCAGGCGGTCGACGAGGCGGGAACGGGTTTCGCCACCTACCAC
GTGATGAACCCCCACGACGACGGGATCGGCCTCGACGAATTCGTCGACTGGCTCGTCGAG
GCGGGGTATCGCATCGACCGCATCGACTACTACGCGGCCTGGCTGCAGCGGTTCGAAACC
GCCCTGCGGGCGCTGCCCGAGCGCACTCGGCAGTACTCACTGCTCCCGCTGCTGCACAAC
TACCAGCGGCCTGCGCACCCGATCAACGGGGCGATGGCCCCGACCGACCGGTTCCGCGCT
GCGGTGCAGGAGGCAAAGCTCGGCCCGGACAAGGACATTCCCCACGTCACTCCAGCGGTG
ATCGTCAAGTACGCCACCGACCTGGAGCTGCTGGGCCTGATCTAG

Amino acid sequence (SEQ ID NO:48)

>uniprot|A1UFA8|A1UFA8_MYCSK Thioester reductase domain

MSTETREARLQQRIAHLFTTDPQFAAARPDPRISDAVDRDDTRLTAIVSA
VMSGYADRPALGQRAAEFVTDPQTGRTTMELLPRFDTITYRELLDRVRAL

FIG. 4 (Cont.)

TNAWHADGVRPGDRVAILGFTGIDYTVVDLALIQLGAVAVPLQTSAAVEA
LRPIVAETEPMLIATGVDHVDAAAELALTGHRPSRVVVFDHREQVDDERD
AVRAATARLGDAVPVETLAEVLRRGAHLPAVAPHVFDEADPLRLLIYTSG
SAGAPKGAMYPESKVAGMWRASAKAAWNNDQTAIPSITLNFLPMSHVMGR
GLLCGTLSTGGTAYFAARSDLSTLLEDLRLVRPTQLSFVPRIWDMLFQEF
VGEVDRRVNDGADRPTAEADVLAVQRHELLGGRFVTAMTGSAPISLEMKT
WVETLLDMHLVEGYGSTEAGAVFVDGHIQRPPVLDYKLVDVPDLGYFSTD
RPHPRGELLVRSTQLFPGYYKRPDVTAEVFDDDGFYRTGDIVAEVGPDQV
QYLDRRNNVLKLAQGEFVTISKLEAVFAGSALVRQIYVYGNSARSYLLAV
VVPTDDAVARHDPASLKTAISASLQQAAKTAGLQSYELPRDFLVETQPFT
LENGLLTGIRKLARPKLKARYGDRLEALYVELVEGQAGELRTLRRDGAKR
PVAETVGRAAAALLGAAAADVRPDAHFTDLGGDSLSALTFGNLLQEIFGV
DVPVGVIVSPAADLASIAAYIEAEQASTGKRPTYASVHGRDAEQVHARDL
TLDKFIDAETLSAATELPGPSGEVRTVLLTGATGFLGRYLALDWLERMAL
VDGKVICLVRAKDDAAARKRLDDTFDSGDPKLLAHYRKLAADHLEVLAGD
KGEADLGLPHPVWQRLADTVDLIVDPAALVNHVLPYSQLFGPNALGTAEL
IRLALTTRIKPFTYVSTIGVGAGIEPGRFTEDDDIRVISPTRAVDTGYAN
GYGNSKWAGEVLLREAHDLCGLPVAVFRCDMILADTTYAGQLNLPDMFTR
MMLSLVTTGIAPKSFHPLDAKGHRQSAHYDGLPVEFVAESISALGAQAVD
EAGTGFATYHVMNPHDDGIGLDEFVDWLVEAGYRIDRIDYYAAWLQRFET
ALRALPERTRQYSLLPLLHNYQRPAHPINGAMAPTDRFRAAVQEAKLGPD
KDIPHVTPAVIVKYATDLELLGLI

ZP_05217435

Nucleotide sequence (SEQ ID NO:49)

>gi|222089526:2534-6055 Mycobacterium avium subsp. avium ATCC 25291
NZ_ACFI01000138, whole genome shotgun sequence ATGTCGACTGCCACCCATGACGAACGACTCGACCGTCGCGTCCACGAACTCATCGCCACCGACCCGCAAT
TCGCCGCCGCCCAACCCGACCCGGCGATCACCGCCGCCCTCGAACAGCCCGGGCTGCGGCTGCCGCAGAT
CATCCGCACCGTGCTCGACGGCTACGCCGACCGGCCGGCGCTGGGACAGCGCGTGGTGGAGTTCGTCACG
GACGCCAAGACCGGGCGCACGTCGGCGCAGCTGCTCCCCCGCTTCGAGACCATCACGTACGGCGAAGTGG
CGCAGCGTGTTTCGGCGCTGGGCCGCGCCCTGTCCGACGACGCGGTGCACCCCGGCGACCGGGTGTGCGT
GCTGGGCTTCAACAGCGTCGACTACGCCACCATCGACATGGCGCTGGGCGCCATCGGCGCCGTCTCGGTG
CCGCTGCAGACCAGCGCGGCAATCAGCTCGCTGCAGCCGATCGTGGCCGAGACCGAGCCCACCCTGATCG
CGTCCAGCGTGAACCAGCTGTCCGACGCGGTGCAGCTGATCACCGGCGCCGAGCAGGCGCCCACCCGGCT
GGTGGTGTTCGACTACCACCCGCAGGTCGACGACCAGCGCGAGGCCGTCCAGGACGCCGCGGCGCGGCTG
TCCAGCACCGGCGTGGCCGTCCAGACGCTGGCCGAGCTGCTGGAGCGCGGCAAGGACCTGCCCGCCGTCG
GGGAGCCGCCCGCCGACGAGGACTCGCTGGCCCTGCTGATCTACACCTCCGGGTCCACCGGCGCCCCCAA
GGGCGCGATGTACCCGCAGAGCAACGTCGGCAAGATGTGGCGCCGCGGCAGCAAGAACTGGTTCGGCGAG
AGCGCCGCGTCGATCACCCTGAACTTCATGCCGATGAGCCACGTGATGGGCCGAAGCATCCTCTACGGCA
CGCTGGGCAACGGCGGCACCGCCTACTTCGCCGCCCGCAGCGACCTGTCCACCCTGCTCGAGGACCTCGA
GCTGGTGCGGCCCACCGAGCTCAACTTCGTCCCGCGGATCTGGGAGACGCTGTACGGCGAATTCCAGCGT
CAGGTCGAGCGGCGGCTCTCCGAGTCCGGGGACGCCGGCGAACGTCGCGCCGTCGAGGCCGAGGTGCTGG
CCGAGCAGCGCCAGTACCTGCTGGGCGGCGGTTCACCTTCGCGATGACGGGCTCGGCGCCCATCTCGCC
GGAGCTGCGCAACTGGGTCGAGTCGCTGCTCGAAATGCACCTGATGGACGGCTACGGCTCCACCGAGGCC
GGAATGGTGTTGTTCGACGGGGAGATTCAGCGCCCGCCGGTGATCGACTACAAGCTGGTCGACGTGCCGG
ACCTGGGCTACTTCAGCACCGACCGGCCGCATCCGCGCGGCGAGCTGCTGCTGCGCACCGAGAACATGTT
CCCGGGCTACTACAAGCGGGCCGAAACCACCGCGGGCGTCTTCGACGAGGACGGCTACTACCGCACCGGC
GACGTGTTCGCCGAGATCGCCCCGGACCGGCTGGTCTACGTCGACCGCCGCAACAACGTGCTCAAGCTGG
CGCAGGGCGAATTCGTCACGCTGGCCAAGCTGGAGGCGGTGTTCGGCAACAGCCCGCTGATCCGCCAGAT

FIG. 4 (Cont.)

CTACGTCTACGGCAACAGCGCCCAGCCCTACCTGCTGGCGGTCGTGGTGCCCACCGAGGAGGCGCTGGCC
TCGGGTGACCCCGAGACGCTCAAGCCCAAGATCGCCGACTCGCTGCAGCAGGTCGCCAAGGAGGCCGGCC
TGCAGTCCTACGAGGTGCCGCGCGACTTCATCATCGAGACCACCCCGTTCAGCCTGGAAAACGGTCTGCT
GACCGGGATCCGGAAGCTGGCGTGGCCGAAACTGAAGCAGCACTACGGGGAACGGCTGGAGCAGATGTAC
GCCGACCTGGCCGCCGGACAGGCCAACGAGCTGGCCGAGCTGCGCCGCAACGGTGCCCAGGCGCCGGTGC
TGCAGACCGTGAGCCGCGCCGCGGGCGCCATGCTGGGTTCGGCCGCCTCCGACCTGTCCCCCGACGCCCA
CTTCACCGATCTGGGCGGAGACTCGTTGTCGGCGTTGACATTCGGCAACCTGCTGCGCGAGATCTTCGAC
GTCGACGTGCCGGTGGGCGTCATCGTCAGCCCGGCCAACGACCTGGCGGCCATCGCGAGCTACATCGAGG
CCGAGCGGCAGGGCAGCAAGCGCCCGACGTTCGCCTCGGTGCACGGCCGGGACGCGACCGTGGTGCGCGC
CGCCGACCTGACGCTGGACAAGTTCCTCGACGCCGAGACGCTGGCCGCCGCGCCGAACCTGCCCAAGCCG
GCCACCGAGGTGCGCACCGTGCTGCTGACCGGCGCCACCGGCTTCCTGGGCCGCTACCTGGCCCTGGAAT
GGCTGGAGCGGATGGACATGGTGGACGGCAAGGTCATCGCCCTGGTCCGGGCCCGCTCCGACGAGGAGGC
ACGCGCCCGGCTGGACAAGACCTTCGACAGCGGCGACCCGAAGCTGCTCGCGCACTACCAGCAGCTGGCC
GCCGATCACCTGGAGGTCATCGCCGGCGACAAGGGCGAGGCCAATCTGGGCCTGGGCCAAGACGTTTGGC
AACGACTGGCCGACACGGTCGACGTGATCGTCGACCCCGCCGCGCTGGTCAACCACGTGTTGCCGTACAG
CGAGCTGTTCGGGCCCAACGCCCTGGGCACCGCGGAGCTGATCCGGCTGGCGCTGACGTCCAAGCAGAAG
CCGTACACCTACGTGTCCACCATCGGCGTGGGCGACCAGATCGAGCCGGGCAAGTTCGTCGAGAACGCCG
ACATCCGGCAGATGAGCGCCACCCGGGCGATCAACGACAGCTACGCCAACGGCTACGGCAACAGCAAGTG
GGCCGGCGAGGTGCTGCTGCGCGAGGCGCACGACCTGTGCGGGCTGCCCGTCGCGGTGTTCCGCTGCGAC
ATGATCCTGGCCGACACCACGTATGCCGGGCAGCTCAACCTGCCGGACATGTTCACCCGGCTGATGCTGA
GCCTGGTGGCCACCGGGATCGCGCCCGGCTCGTTCTACGAGCTCGACGCCGACGGCAACCGGCAGCGGGC
GCACTACGACGGCCTGCCGGTCGAGTTCATCGCCGCGGCGATCTCGACGCTGGGTTCGCAGATCACCGAC
AGCGACACCGGCTTCCAGACCTACCACGTGATGAACCCCTACGATGACGGCATCGGTCTGGACGAGTACG
TCGATTGGCTGGTGGACGCCGGCTATTCGATCGAGCGGATTGCCGACTACTCCGAATGGCTGCGGCGGTT
CGAGACCTCGCTGCGGGCCCTGCCGGACCGGCAGCGCCAGTACTCGCTGCTGCCGCTGCTGCACAACTAC
CGCACGCCGGAGAAGCCGATCAACGGGTCGATAGCTCCCACCGACGTGTTCCGGGCAGCGGTGCAGGAGG
CGAAAATCGGCCCCGACAAAGACATTCCGCACGTGTCGCCGCCGGTCATCGTCAAGTACATCACCGACCT
GCAGCTGCTCGGGCTGCTCTGA

Amino acid sequence (SEQ ID NO:50)

>gi|254775919|ref|ZP_05217435.1| FadD9 [Mycobacterium avium subsp. avium ATCC 25291]

MSTATHDERLDRRVHELIATDPQFAAAQPDPAITAALEQPGLRLPQIIRTVLDGYADRPALGQRVVEFVT
DAKTGRTSAQLLPRFETITYGEVAQRVSALGRALSDDAVHPGDRVCVLGFNSVDYATIDMALGAIGAVSV
PLQTSAAISSLQPIVAETEPTLIASSVNQLSDAVQLITGAEQAPTRLVVFDYHPQVDDQREAVQDAAARL
SSTGVAVQTLAELLERGKDLPAVGEPPADEDSLALLIYTSGSTGAPKGAMYPQSNVGKMWRRGSKNWFGE
SAASITLNFMPMSHVMGRSILYGTLGNGGTAYFAARSDLSTLLEDLELVRPTELNFVPRIWETLYGEFQR
QVERRLSESGDAGERRAVEAEVLAEQRQYLLGGRFTFAMTGSAPISPELRNWVESLLEMHLMDGYGSTEA
GMVLFDGEIQRPPVIDYKLVDVPDLGYFSTDRPHPRGELLLRTENMFPGYYKRAETTAGVFDEDGYYRTG
DVFAEIAPDRLVYVDRRNNVLKLAQGEFVTLAKLEAVFGNSPLIRQIYVYGNSAQPYLLAVVVPTEEALA
SGDPETLKPKIADSLQQVAKEAGLQSYEVPRDFIIETTPFSLENGLLTGIRKLAWPKLKQHYGERLEQMY
ADLAAGQANELAELRRNGAQAPVLQTVSRAAGAMLGSAASDLSPDAHFTDLGGDSLSALTFGNLLREIFD
VDVPVGVIVSPANDLAAIASYIEAERQGSKRPTFASVHGRDATVVRAADLTLDKFLDAETLAAAPNLPKP
ATEVRTVLLTGATGFLGRYLALEWLERMDMVDGKVIALVRARSDEEARARLDKTFDSGDPKLLAHYQQLA
ADHLEVIAGDKGEANLGLGQDVWQRLADTVDVIVDPAALVNHVLPYSELFGPNALGTAELIRLALTSKQK
PYTYVSTIGVGDQIEPGKFVENADIRQMSATRAINDSYANGYGNSKWAGEVLLREAHDLCGLPVAVFRCD
MILADTTYAGQLNLPDMFTRLMLSLVATGIAPGSFYELDADGNRQRAHYDGLPVEFIAAAISTLGSQITD
SDTGFQTYHVMNPYDDGIGLDEYVDWLVDAGYSIERIADYSEWLRRFETSLRALPDRQRQYSLLPLLHNY
RTPEKPINGSIAPTDVFRAAVQEAKIGPDKDIPHVSPPVIVKYITDLQLLGLL

Nucleotide sequence (SEQ ID NO:51)

>uniprot|A3PYW9|A3PYW9_MYCSJ Thioester reductase domain

ATGTCCACCGAGACCCGTGAAGCGCGCCTGCAGCAGCGCATCGCGCATCTGTTCGCCACC
GACCCGCAGTTCGCCGCCGCCCGGCCCGACCCCCGGATCAGCGATGCCGTCGACCGCGAT
GACGCGCGGCTGACCGCCATCGTCTCCGCCGTCATGTCGGGGTACGCCGACCGGCCGGCA
CTCGGGCAGCGCGCCGCCGAATTCGCCACCGACCCGCAGACCGGCCGCACCACGATGGAG
CTGCTCCCCCGCTTCGACACCATCACCTACCGGGAGCTGCTCGACCGCGTCCGGGCGCTC
ACCAACGCGTGGCACGCCGACGGGGTGCGCCCCGGCGACCGCGTCGCAATCCTCGGATTC
ACCGGCATCGACTACACCGTCGTCGACCTCGCCCTGATCCAGCTCGGCGCGGTCGCGGTG
CCGCTGCAGACCAGCGCCGCCGTGGAGGCGCTGCGCCCGATCGTGGCCGAGACCGAACCG
ATGCTCATCGCCACCGGCGTCGATCATGTCGACGCCGCCGCGGAACTCGCACTCACCGGC
CACCGTCCGTCCCAGGTGGTGGTCTTCGACCACCGCGAGCAGGTCGACGACGAACGCGAC
GCGGTGCGGGCCGCGACGGCCCGGCTGGGAGACGCGGTGCCCGTCGAGACACTCGCCGAG
GTGTTGCGGCGTGGCGCCCATCTGCCCGCCGTGGCACCGCACGTGTTCGACGAGGCCGAT
CCACTGCGGCTGCTGATCTACACCTCCGGCAGCACCGGCGCCCCCAAGGGCGCGATGTAT
CCCGAGAGCAAGGTCGCCGGCATGTGGCGCGCGTCGGCCAAGGCCGCCTGGAACAACGAT
CAGACGGCGATTCCGTCGATCACCCTGAACTTCCTGCCGATGAGCCACGTCATGGGTCGC
GGCCTGCTGTGCGGCACGCTCAGCACCGGTGGCACCGCGTATTTCGCCGCCCGCAGCGAT
CTGTCGACGCTGCTCGAGGACCTGCGCCTGGTACGGCCCACCCAACTCAGCTTCGTGCCA
CGGATCTGGGACATGCTCTTCCAGGAGTTCGTCGGCGAGGTCGACCGGCGGGTGAACGAC
GGTGCAGACCGCCCCACCGCGGAGGCCGACGTGCTGGCCGAACTGCGCCAGGAGCTGCTC
GGTGGCCGGTTCGTCACCGCGATGACCGGTTCGGCGCCCATCTCCCCCGAGATGAAGACA
TGGGTGGAGACCCTGCTCGACATGCACCTGGTCGAGGGTTACGGCTCGACGGAGGCCGGC
GCGGTGTTCGTCGACGGCCACATCCAGCGCCCGCCGGTGCTCGACTACAAACTCGTCGAC
GTCCCCGACCTCGGCTACTTCAGCACCGACCGGCCGCACCCGCGCGGTGAGCTGCTGGTC
CGCTCCACGCAGCTGTTCCCCGGCTACTACAAGCGTCCCGACGTCACCGCCGAGGTGTTC
GACGACGACGGCTTCTACCGCACGGGCGACATCGTCGCCGAGCTCGGCCCCGACCAGCTG
CAGTACCTCGACCGCCGCAACAACGTGCTCAAACTCGCCCAGGGTGAGTTCGTCACCATC
TCCAAACTCGAGGCGGTCTTCGCCGGCAGCGCCCTCGTCCGCCAGATCTTCGTGTACGGC
AACAGTGCGCGCTCCTACCTGCTGGCCGTCGTCGTGCCGACCGACGATGCGGTGGCCCGG
CACGACCCGGCATCGCTCAAGACCGCGATCAGCGCCTCGCTGCAGCAGGCCGCGAAGACC
GCCGGTCTGCAGTCCTACGAGCTGCCGCGTGACTTCCTCGTCGAGACTCAACCGTTCACG
CTGGAGAACGGACTACTGACCGGCATCCGCAAGCTGGCCCGCCCGAAACTCAAGGCGCGC
TACGGCGATCGGCTCGAGGCGCTCTACGTCGAACTGGCCGAAGGACAGGCAGGCGAACTG
CGCACCCTGCGCCGGGACGGCGCGAAGCGTCCGGTGGCCGAGACGGTCGGCCGCGCCGCG
GCCGCGCTGCTCGGCGCCGCCGCCGCCGACGTGCGCCCCGACGCGCACTTCACCGACCTC
GGCGGAGACTCGTTGTCGGCGTTGACCTTCGGCAATCTGCTGCAGGAGATCTTCGGCGTC
GACGTCCCGGTCGGGGTGATCGTCAGCCCGGCGGCCGACCTGGCGTCGATCGCGGCGTAC
ATCGAGACCGAACAGGCCTCGACCGGCAAGCGGCCGACCTACGCGTCGGTGCACGGGCGC
GACGCCGAACAGGTACGCGCGCGCGACCTCACCCTGGACAAGTTCATCGACGCCGAAACA
CTCTCCGCTGCAACAGAACTGCCCGTCCCGATCGGTGAGGTGCGCACCGTGCTGCTGACC
GGGGCCACCGGATTCCTCGGCCGCTACCTGGCGCTGGACTGGCTCGAAAGGATGGCCCTG
GTCGACGGCAAGGTCATCTGCCTGGTCCGCGCGAAGGACGATGCGGCCGCCCGCAAACGC
CTCGACGACACCTTCGACAGCGGCGATCCGAAGCTGCTGGCGCACTACCGCAAGCTGGCC
GCCGACCACCTCGAAGTGCTGGCCGGCGACAAGGGTGAGGCGGATCTCGGGCTGCCGCAT
CAGGTCTGGCAGCGACTGGCCGACACCGTCGACCTCATCGTCGACCCGGCCGCCCTGGTC
AACCACGTACTGCCGTACAGCCAGCTGTTCGGGCCCAACGCGCTGGGCACTGCCGAGCTG

FIG. 4 (Cont.)

ATCCGGCTTGCGCTCACCACCCGCATCAAACCGTTCACCTACGTGTCGACGATCGGCGTC
GGCGCCGGTATCGAACCGGGCCGTTTCACCGAGGACGACGACATCCGGGTGATCAGCCCG
ACGCGGGCCGTCGACACCGGGTACGCCAACGGCTACGGCAACAGCAAGTGGGCCGGTGAG
GTGTTGTTGCGCGAGGCGCACGATCTGTGCGGGCTCCCCGTGGCGGTGTTCCGGTGCGAC
ATGATCCTGGCCGACACCACCTACGCCGGCCAGCTCAACCTGCCGGACATGTTCACCCGG
ATGATGGTGAGCCTGGTGACCACGGGTATCGCGCCGAAGTCGTTCCACCCACTCGACGCA
AAGGGCCACCGGCAGCGCGCCCACTACGACGGGCTGCCGGTCGAGTTCGTCGCCGAATCG
ATCTCCGCGCTGGGAGCGCAGGCGGTCGACGAGGCGGGAACGGGTTTCGCCACCTACCAC
GTGATGAACCCCCACGACGACGGGATCGGCCTCGACGAATTCGTCGACTGGCTCGTCGAG
GCGGGGTATCGCATCGACCGCATCGACGACTACGCGGCCTGGCTGCAACGGTTCGAAACC
GCGCTGCGGGCGCTGCCCGAGCGCACTCGGCAGTACTCACTGCTCCCGCTGCTGCACAAC
TACCAGCGGCCTGCGCACCCGATCAACGGGGCGATGGCCCCGACCGACCGGTTCCGCGCC
GCGGTGCAGGAGGCAAAGCTCGGCCCGGACAAGGACATTCCCCACGTCACCCCCGGGGTG
ATCGTCAAGTACGCCACCGACCTGGAACTGCTGGGGCTGATCTAG

Amino acid sequence (SEQ ID NO:52)

>uniprot|A3PYW9|A3PYW9_MYCSJ Thioester reductase domain

MSTETREARLQQRIAHLFATDPQFAAARPDPRISDAVDRDDARLTAIVSA
VMSGYADRPALGQRAAEFATDPQTGRTTMELLPRFDTITYRELLDRVRAL
TNAWHADGVRPGDRVAILGFTGIDYTVVDLALIQLGAVAVPLQTSAAVEA
LRPIVAETEPMLIATGVDHVDAAAELALTGHRPSQVVVFDHREQVDDERD
AVRAATARLGDAVPVETLAEVLRRGAHLPAVAPHVFDEADPLRLLIYTSG
STGAPKGAMYPESKVAGMWRASAKAAWNNDQTAIPSITLNFLPMSHVMGR
GLLCGTLSTGGTAYFAARSDLSTLLEDLRLVRPTQLSFVPRIWDMLFQEF
VGEVDRRVNDGADRPTAEADVLAELRQELLGGRFVTAMTGSAPISPEMKT
WVETLLDMHLVEGYGSTEAGAVFVDGHIQRPPVLDYKLVDVPDLGYFSTD
RPHPRGELLVRSTQLFPGYYKRPDVTAEVFDDDGFYRTGDIVAELGPDQL
QYLDRRNNVLKLAQGEFVTISKLEAVFAGSALVRQIFVYGNSARSYLLAV
VVPTDDAVARHDPASLKTAISASLQQAAKTAGLQSYELPRDFLVETQPFT
LENGLLTGIRKLARPKLKARYGDRLEALYVELAEGQAGELRTLRRDGAKR
PVAETVGRAAAALLGAAAADVRPDAHFTDLGGDSLSALTFGNLLQEIFGV
DVPVGVIVSPAADLASIAAYIETEQASTGKRPTYASVHGRDAEQVRARDL
TLDKFIDAETLSAATELPVPIGEVRTVLLTGATGFLGRYLALDWLERMAL
VDGKVICLVRAKDDAAARKRLDDTFDSGDPKLLAHYRKLAADHLEVLAGD
KGEADLGLPHQVWQRLADTVDLIVDPAALVNHVLPYSQLFGPNALGTAEL
IRLALTTRIKPFTYVSTIGVGAGIEPGRFTEDDDIRVISPTRAVDTGYAN
GYGNSKWAGEVLLREAHDLCGLPVAVFRCDMILADTTYAGQLNLPDMFTR
MMVSLVTTGIAPKSFHPLDAKGHRQRAHYDGLPVEFVAESISALGAQAVD
EAGTGFATYHVMNPHDDGIGLDEFVDWLVEAGYRIDRIDDYAAWLQRFET
ALRALPERTRQYSLLPLLHNYQRPAHPINGAMAPTDRFRAAVQEAKLGPD
KDIPHVTPGVIVKYATDLELLGLI

CAR70557

Nucleotide sequence (SEQ ID NO:53)

>gi|219932450:561817-562104 Mycobacterium leprae Br4923, complete genome sequence
ATGAGCACCGTGGATGGTGTGTGTGATGAAGACATATATTACTATTATGACTGCATATATTGCGCTGCCG
ATGTTGCCAGCCCGACTGGGTATTTACCCGGAGGACTCTTTAGCTTGGCGAAGCTGCTTGTTATACGTGG

FIG. 4 (Cont.)

GGAGAAGCAGTATGTCTTCGGCCTGAATGACTCGACGAGTGTCGGCCCCGGGCCGGGCAACATGCCCTGG
CTGGACGACCCAGGCCTGTCTGCTGTCATTGCGAGTTCCGTCGCAGCGGCTGAATTGGCTGCTGCGCGAT
CCTGGTAA

Amino acid sequence (SEQ ID NO:54)

>gi|219932734|emb|CAR70557.1| hypothetical protein [Mycobacterium leprae Br4923]
MSTVDGVCDEDIYYYYDCIYCAADVASPTGYLPGGLFSLAKLLVIRGEKQYVFGLNDSTSVGPGPGNMPW
LDDPGLSAVIASSVAAAELAAARSW

YP 001220863.1

Nucleotide sequence (SEQ ID NO:55)

>uniprot|A5CM59|A5CM59_CLAM3 Putative acyl-CoA synthetase

ATGAGCACTGAGCAGATGGGCACCGAGCAGATGGGGAGCCAGCACGAGGACACGTCGATC
GAGGCGATCTTCGCGCAGCACGCCGACCGGACGGCGCTGCGGCAGCGATCCGGGCCGGAC
ATCACGGACATGGGCTTCCGGGAGCTGTGGGACCGGGCGGGCGCGCTGGCCGCGGCGCTC
GGCGAGACCGTGTCCGCCGGAGACCGCATCGCGGTGCTCGGCACGGCGACCGCGGACGCC
GTCACGCTCGACCTCGCCGCGTGGATCCTCGGCGCGGTGAGCGTGCCCCTCCAGGCGAGC
GCGCCCGTCGCGGCCCTGCGCGCGATCGTCGAGGAGACGACGCCGGTGTGGATCGCGGCC
ACCGCCGACCAGGCCGCGACGGCCCGGGCGGTCGCCGAGGCATCGGGCGACGGCATCCGG
ACGATGCGGCTCGACACCGACACCGACGCGGACACCGACACCGACGCCGCCCTGACGCTC
GGCGCGCTCGTCGCCCGCGGGGCCGGCCTGCGTCGCCGGAGCCCGTGGCACCCCGCACCC
GGCGACGACCCGCTCGCGCTCCTGCTCTACACGTCGGGCAGCACGGGCACGCCGAAGGGC
GCGATGTACACGCGCTCCATGGTCGAGCGGATGTGGCACGCCCTCCGGCCCGACCCCGCC
GCGCCCGCCGACGCATCCACGACCGCGGACGACGGAGACGCCGCAGCCATCGTCGGGTAC
GCGTACCTCCCCATGAGCCACCTCACCGGCCGCTCCTCCCTGCTCGCCACGCTCGGCCGC
GGCGGCACGGTCGCGCTCGCGACCTCGACCGACCTGTCGACGCTCTTCGACGACCTGCGG
ACCTTCGCCCCGACCGAGTTCGTCTTCGTGCCGCGCGTCGCGGAGCTGGTGCGGCAGGAG
GGCGACCGCGAGGAGCAGCGCCGACTCACCGCCGGCAGCACGGACCGGGACGCGGTCCGC
GCCGAGGTCCAGGCCGACCTGCGCGCCCGCGCGTTCGGCGGACGGATCCACCGGGCGATC
TGCACCAGCGCACCGCTGACGCCGGAGCTCCGCACGTACATCGAGGGATGCCTCGGGCTG
ACGCTGCACGACCTGTACGGGTCGACCGAGGCCGGCGGCATCCTCCACGACGGGGTGATC
CAGCAGCCTCCCGTCACCGAGCACAAGCTCGTCGACGTCCCCGAGCTCGGGTACCGCACC
ACCGACCGCCCGCACCCGCGGGGCGAGCTGCTCGTCAAGAGCGCCTCCGTGATCGCCGGG
TACTTCCGCCGGCCGGACGTCACCGCCGCGGTGTTCGACGAGGACGGCTTCTACCGGACC
GGCGACGTCATGGCGCAGACCGGACCCGGCACCTACGAGTACGTCGACCGTCGGAACAAC
GTGATCAAGCTGTCGCAGGGCGAGTTCGTCGCGGTGGCATCGCTCGAGGCGACGTACGGC
GGGACGCCCGAGGTGCACCAGATCGCGCTGCACGGCGACAGCCGGCACGCGTTCCTCGTC
GCGGTCGTCGTCCCGGCGGACCCCGCGGCGTCGGAGCGCGACATCCTCGCGGCCCTCCAG
CGCACCGCCCGCGAGCACGGCCTCGCCCCCTACGAGGTGCCCCGCGGCGTGATCGTCGAA
CCGGATCCGTTCACGGTCGACGGCGGCATGCTCTCCGACGCCGGCAAGCTCCTGCGCCTG
CGCCTCACGCAGCGGTACGGCGAGCGCCTCGCCGCCCTCTACGACGCGCTCGAGGAGCAG
CAGAGCGGCACCCTCGTCGCCGCGCTCCGCGAACGCGCCGACGACGAGCCGACGGTCGAC
ACGGTGGTGCGCGCCGCCCTCCTGCTCCTCGGGGCCGAGGTGTCCCCCGCGACCGCCGCC

FIG. 4 (Cont.)

GCTGCCCGGTTCTCCGACCTCGGCGGCGACTCGCTGTCCGCGCTGACGTTCTCCGGGATC
CTCGAGGACGTCTTCGGCACCGAGGTGCCCGTCGGCGTCCTCACCGACCCGACCAACGAC
CTCGCCGCCGTCGCCGCCTACGTGGAGCGCTCCGCCTCCGACGACCGGCCGACCGTGACC
CGCGTGCACGGCGCCGGCGCATCCACCCTCCGCGTGGGCGACCTCCGGCTCGACCGGATG
CTCGGCGGCATCCCGACGCCGGTCCCCCGGGCCTCGGCCGCCCGGCCGGGATCCCGCACG
GTCCTGCTCACCGGCGCGAACGGCTACCTCGGCCGGTTCCTGGCCATCGACTGGCTCGAG
CGCCTCGCTGCGACGGGCGGCACGCTGGTGTGCATCGTGCGCGGCGCCGACGACGCCGAC
GCCCGGCGCCGCCTCGAGGCCGCGTTCGCCGCGGATCCCGCGTTCGCCCGGCGCTTCGCC
GAGCTGTCGGGCTCGCTCGAGGTGCTGGCCGGAGACGTCAGCGAGCACCGCCTCGGCCTC
GACGACGAGCGGTGGATCGACCTGGCCGCGCGGGTCGACCTCGTCGCGCACGCGGCTGCC
CTCGTGAACCACGTCCTCCCGTACTCGGCGCTGTTCGGTCCGAACGTCGTCGGCACCGCC
GAGGCGATCCGCCTGGCGATCGCCGCCGGCAGCGTGCCCGTCACCTTCGTCTCGAGCGTC
GCGGTCGCGGGCGGCGCGCGGCCGGGCGCGACCGCCGACGCCGAGCCGTCGGCGCCCGGC
GCGCTCGACGAGCACGCCGACATCCGCGCCACGATCCCCGAGTGGGCCGTCGGCGACGAG
TACGCCAACGGGTACGGCGCGAGCAAGTGGGCGAGCGAGGTGCTGCTCCGCGAGGCGCAC
GAGCACCACGGCGTCCCCGTGGCCGTGTTCCGCTCCGACATGATCCTGGCGCACCCCCGC
TGGCGCGGTCAGGTGAACCTCCCCGACGTCTTCACCCGGCTGATCTGGAGCGTGCTCACC
ACCGGCCTCGCCCCCGCATCGTTCGTGAGGCGCGGCCCCGACGGCGAGCGGCAGCGGTCG
CACTACGACGGGCTGCCGGCCGACTTCACGGCGGCGGCGATCGACGGGATCGGCGCGGCG
CTCACCGAGGGGCACCGCACCTTCAACGTCGTGAACCCCCACGACGACGGCGTCTCGCTC
GACACCTTCGTCGACTGGATCCGCGAGGACGGCCACGACATCGCGCGCGTGGACGACCAC
GCGGAGTGGGTCGACCGGTTCCGCGCGGCGCTGGGAGCGCTCCCGGACGCGGACCGCGCC
CGGTCCGTCCTGCCGCTGATGCACGCGTTCGCCTCGCCCGAGGAGCCGCACGCCGGCTCG
GCGATCCCGGCGGATGCGTTCGCCGAGGCCGTCCGCGCGGTGCGCCCGCTCGGGTCGCCG
GACATCCCGTCTCTCGACCACGCGCTCATCGCCAAGGTCGCCGACGACCTCGCGTTCCTG
GGGCTGCTCGCGCCGGCGCGGGCGGCGGCTGCCTGA

Amino acid sequence (SEQ ID NO:56)
>uniprot|A5CM59|A5CM59_CLAM3 Putative acyl-CoA synthetase MSTEQMGTEQMGSQHEDTSIEAIFAQHADRTALRQRSGPDITDMGFRELW
DRAGALAAALGETVSAGDRIAVLGTATADAVTLDLAAWILGAVSVPLQAS
APVAALRAIVEETTPVWIAATADQAATARAVAEASGDGIRTMRLDTDTDA
DTDTDAALTLGALVARGAGLRRRSPWHPAPGDDPLALLLYTSGSTGTPKG
AMYTRSMVERMWHALRPDPAAPADASTTADDGDAAAIVGYAYLPMSHLTG
RSSLLATLGRGGTVALATSTDLSTLFDDLRTFAPTEFVFVPRVAELVRQE
GDREEQRRLTAGSTDRDAVRAEVQADLRARAFGGRIHRAICTSAPLTPEL
RTYIEGCLGLTLHDLYGSTEAGGILHDGVIQQPPVTEHKLVDVPELGYRT
TDRPHPRGELLVKSASVIAGYFRRPDVTAAVFDEDGFYRTGDVMAQTGPG
TYEYVDRRNNVIKLSQGEFVAVASLEATYGGTPEVHQIALHGDSRHAFLV
AVVVPADPAASERDILAALQRTAREHGLAPYEVPRGVIVEPDPFTVDGGM
LSDAGKLLRLRLTQRYGERLAALYDALEEQQSGTLVAALRERADDEPTVD
TVVRAALLLLGAEVSPATAAAARFSDLGGDSLSALTFSGILEDVFGTEVP
VGVLTDPTNDLAAVAAYVERSASDDRPTVTRVHGAGASTLRVGDLRLDRM
LGGIPTPVPRASAARPGSRTVLLTGANGYLGRFLAIDWLERLAATGGTLV
CIVRGADDADARRRLEAAFAADPAFARRFAELSGSLEVLAGDVSEHRLGL
DDERWIDLAARVDLVAHAAALVNHVLPYSALFGPNVVGTAEAIRLAIAAG
SVPVTFVSSVAVAGGARPGATADAEPSAPGALDEHADIRATIPEWAVGDE
YANGYGASKWASEVLLREAHEHHGVPVAVFRSDMILAHPRWRGQVNLPDV
FTRLIWSVLTTGLAPASFVRRGPDGERQRSHYDGLPADFTAAAIDGIGAA
LTEGHRTFNVVNPHDDGVSLDTFVDWIREDGHDIARVDDHAEWVDRFRAA
LGALPDADRARSVLPLMHAFASPEEPHAGSAIPADAFAEAVRAVRPLGSP
DIPSLDHALIAKVADDLAFLGLLAPARAAAA

Nucleotide sequence (SEQ ID NO:57)

>uniprot|A8M8D3|A8M8D3_SALAI Thioester reductase domain

GTGACCACCACGGAGCAGACCCTCACCGAGCGGCTCATCGCCGAGGACGAGCAGATCCGG
CGGGCCCAGGTCAGCGCCGAAGTCTCCGCCGCGATGCGGGTGCCGGGCATGTCGCAGGCC
CAGATCGTGGCCGCCGGATTCACCGGTTACGCCGACCGCGCCGCCCTGGGTGAGCGCGCC
CGCGAAGCCGTCACCGACCCGGTCACCGGCCGCACCACCCACCGGCTTCTGCCATGGTTC
GACACCATCACCTACGGCGAGGTCCGGTCGCGGGTGCTGGCGATCTCCGCCGCCTGGTGG
CACGACGTGGACGCTCCACTCCGTCCCGGCGCCTTCGTCGTTTCGGTCGGCGTCCCCAGC
GCCGACCTCGTGACGGTCGAGCTCGCGGTGCTACACACCGGCGCGGTCAGTGTGCCACTG
CAGGTCAGCTCCACCGCCGAGCAACTGCGCCCGATCCTCGACGAGGCCGCCCCGCTCATC
GTGGCCACGAGCGTGGACCGGCTCGCTGTGGTGACCGCGGCGATGTCGGGCAACGCGTCG
GTGCGCCGGATCATGGTCCTGAACCACGACGCAGCGATCACCGCCCACCGGGATGCCGTG
GACGCCGCGCGATCGGCGCTCGCCGGCACCGCAGTCGTCGTGCACACATTGACCGAGGTG
TTGGACCGTGGACGGGGCCTGCCCGCCCCTGAGCCCTACGCGGCGCCCACGGGGGAGGAT
CCCCTGTCGCTGTTGATCTACACCTCGGGCAGTACCGGTACGCCCAAGGGCGCAATGTTT
CCGGAGAGCATGACCCGCGCCAACTGGGTGCGTTTCGACCCCAAGCCGACCGACATGGCG
GTCATCCGGCTCAACTACCTGCCGCTGAGCCACAACGTCGGCCGCATCGTGCTGTTCGAG
GCGCTCGCGGTGGGCGGCATCGCCTTCTTCACCGCACACAGTGACCTGTCCACGCTCCTG
GAGGACATGGCCCTCGCCCGGCCCACCGACCTGTTCCTTATCCCGCGGCTGTGCGACATG
CTCGCCCAGCGCCACGACAGCGAACTGGCCCGCCGCCGCATCACCACCGCGGATCACGAG
GGGGTCCGACAGGTCCACACCCATCTGCGCGAGGCTGTCCTCGGCGGCAGGGTGACCCGC
GCGATGTCGCTGTCCGCGCCGCTGAGCCCACAGCTGCGTCGGTTCGTGGAGTCGTGTCTC
GGCTTCGCGGTGCACGATGTCTTCGGGTCGACCGAGGCCGGCGGGCTGCTCGTCAACGGC
CGGGTGCTGCGCCCGCCGGTGCTCGACTATCGCTTGGTCGACGTCCCCGACCTCGGCTAC
TTCACCACCGACCGTCCGTACCCTCGCGGGGAGCTGCTGGTGCGGACCGCGACGATCATC
CCCGGCTACTACCAGCGGCCCGAGCTCAACGCCGAGCTGTTCACCGAGGACGGCTACTAC
CGCACCGGCGACATCATGGCCGAGTACGGCCCCGACCACCTCGGCTATGTCGACCGCACC
ACGAGCGTGCTGAAGCTGTCACAGGGCGAGTTCGTGGCCGTGTCACGGTTGGAGGAACTG
TTCGCCGCCTCCCCGCTGATCCGGCAGATCTACCTGTACGGCAACAGCGAGCGGCCGTAC
CTGCTCGCCGTGGTCGTGCCCACGGAGGAGGCGCACGCCGCCACCCGGGAACCCGCGGCG
CTCAAGGCGGTGCTCGGCGAGTCGCTGCAACGCATCGCTCAGCAGCACGGCCTGCACCCG
TACGAGGTGCCGCGCGACCTCCTCATCGAGACCACCCCGTTCAGCACCGCCAACGGTCTG
CTCTCCGACATCCGTAAGCCCCTGCGTCCGAAGCTCAAGACCCGGTACGCTCCTCGACTC
GAAGCGCTCTACACCGAGCTCGCCGAGCGCGAGGCCGACCGGATCCGCACGCTGCGCGAC
GCCGGTTCCGCGCAACCCGTGCTGCCCGCGTTGCGCGAGGCTGCCCGGGCGTTCCTCGGC
CGCCCAGGCGCAGCGCTCGACGTGAACGACCGCTTTGTGGACCTCGGCGGCGACTCCCTG
TCGGCCCTGGCCCTGTCGAACCTGCTGAGCGACATCTTCGAGGTCCGCGTCCCGGTCGGC
ATCATGATCAGCGCGACCGGCACGCTCGGTTCCGTGGCGGCCTGGATCGAGGCCGAGCGT
GCCACCGCCGGAGCGGGTATCGGCCGCGCGACGCCCACCTCCGTGCACGGTGCGAACCTC
ACCCAGGTACACGCCGATGACCTGACCCTCGGCACGTTCCTCGACGTGACGACCCTCGCC
GCCGCTGCCTGCCTGCCCCGGGCGCCGCTGTCCGACCCGCGCGTGGTGCTGCTGACGGGT
GCGACCGGCTATCTGGGCCGGTTCCTGGCCCTCGAGTGGCTGGACCGCCTTTCCCGTAGC
GGCGGGACGCTCGTGTGCGTGGTGCGCGCCGCCGACGATGCGGAAGCCGCGCGCCGCCTG
GAAAGTGTCTATGGCTCCAGCGACCCCGAGTTGCTGGAGCGCTTCCGTTCACTCGCCGGC
CACGTGCGCGTGTTGGCCGGCGATGTTGCCGAAGCCAGGTTCGGCCTGCCGGCCGGGGTG
TGGCAGGAACTGGCCGAAACGGTGGACCTGATCGTGCACTCCGCGGCACTGGTCAACCAC
GTTCTCCCGTACGAACAGCTGTTCGGGCCCAACGTGGCGGGAACGGCGGAACTGGTGCGC

FIG. 4 (Cont.)

CTCGCCGTCAGCGTACGGGTGAAGGGAATTGCCTTTCTCTCCACCGTTGCCGTGATCACC
TCGCAGACCACGACACCCGACGAGGACGCGGACATCCGGCAGGCGAGCCCGCACCGGGTG
CTCGACGACAGCTACGCGAACGGCTACGCGGCCAGCAAGTGGGCAGGTGAGGTGCTCCTG
CGACGCGCCCACGAGGAGTACGGCGTGCCGGTCAGCGTGTTCCGCTCGGACGTCATCCTG
GCCCACTCCCGCTACGCCGGGCAGCTCAACGTCCCGGATATGTTCACGCGCCTGCTCCTG
AGCATCCTGGCGACCGGTATTGCCCCAGCGTCGTTTTATCGCACCGGCCCGGACGGCGAA
CGCCAGCCGGCGCACTACGACGGTCTCCCGGTCGACTTCACCGCGGCGGCCGTAGCCGCG
GTGGGTGTCACCGAGGGACACCGCACCTTCAACGTACTGAATCCACACGAGGACGGCATC
GGGCTGGATACCTTTGTGGACTGGCTCGTGGCAGCCGGACACCCGGTGCAGCGCATCGCG
GACCACGACGAGTGGGTGACCCGCTTCGCCACGGCCATGCGTGGGCTGCCTGAACGCCAG
CGCCGCAGCTCGATCCTGCCGCTCCTACACGCCTTTGCCGAGCCCGCTCCGCCGACCTTC
GGATCCAGACTGCCGACGGACCGGTTTCGCGCCGCCGTGAAAGCCGCCAACGTGGTCCCC
GGCAACGAGATCCCGCACCTCGATGCGGCCCTCGTCACCAAGTACGCCGACGACCTCAGG
CTGCTCGACCTTCTCTGA

Amino acid sequence (SEQ ID NO:58)

>uniprot|A8M8D3|A8M8D3_SALAI Thioester reductase domain

VTTTEQTLTERLIAEDEQIRRAQVSAEVSAAMRVPGMSQAQIVAAGFTGY
ADRAALGERAREAVTDPVTGRTTHRLLPWFDTITYGEVRSRVLAISAAWW
HDVDAPLRPGAFVVSVGVPSADLVTVELAVLHTGAVSVPLQVSSTAEQLR
PILDEAAPLIVATSVDRLAVVTAAMSGNASVRRIMVLNHDAAITAHRDAV
DAARSALAGTAVVVHTLTEVLDRGRGLPAPEPYAAPTGEDPLSLLIYTSG
STGTPKGAMFPESMTRANWVRFDPKPTDMAVIRLNYLPLSHNVGRIVLFE
ALAVGGIAFFTAHSDLSTLLEDMALARPTDLFLIPRLCDMLAQRHDSELA
RRRITTADHEGVRQVHTHLREAVLGGRVTRAMSLSAPLSPQLRRFVESCL
GFAVHDVFGSTEAGGLLVNGRVLRPPVLDYRLVDVPDLGYFTTDRPYPRG
ELLVRTATIIPGYYQRPELNAELFTEDGYYRTGDIMAEYGPDHLGYVDRT
TSVLKLSQGEFVAVSRLEELFAASPLIRQIYLYGNSERPYLLAVVVPTEE
AHAATREPAALKAVLGESLQRIAQQHGLHPYEVPRDLLIETTPFSTANGL
LSDIRKPLRPKLKTRYAPRLEALYTELAEREADRIRTLRDAGSAQPVLPA
LREAARAFLGRPGAALDVNDRFVDLGGDSLSALALSNLLSDIFEVRVPVG
IMISATGTLGSVAAWIEAERATAGAGIGRATPTSVHGANLTQVHADDLTL
GTFLDVTTLAAAACLPRAPLSDPRVVLLTGATGYLGRFLALEWLDRLSRS
GGTLVCVVRAADDAEAARRLESVYGSSDPELLERFRSLAGHVRVLAGDVA
EARFGLPAGVWQELAETVDLIVHSAALVNHVLPYEQLFGPNVAGTAELVR
LAVSVRVKGIAFLSTVAVITSQTTTPDEDADIRQASPHRVLDDSYANGYA
ASKWAGEVLLRRAHEEYGVPVSVFRSDVILAHSRYAGQLNVPDMFTRLLL
SILATGIAPASFYRTGPDGERQPAHYDGLPVDFTAAAVAAVGVTEGHRTF
NVLNPHEDGIGLDTFVDWLVAAGHPVQRIADHDEWVTRFATAMRGLPERQ
RRSSILPLLHAFAEPAPPTFGSRLPTDRFRAAVKAANVVPGNEIPHLDAA
LVTKYADDLRLLDLL

YP_001703694.1

Nucleotide sequence (SEQ ID NO:59)

>uniprot|B1MCR9|B1MCR9_MYCAB Probable fatty-acid-CoA ligase FadD

ATGACCGTGACCAACGAAACCAACCCACAGCAGGAGCAGCTATCCCGCCGTATTGAAAGT
CTGCGCGAAAGCGATCCGCAGTTCCGGGCGGCCCAGCCCGACCCGGCGGTCGCCGAACAG

FIG. 4 (Cont.)

GTGCTGCGCCCGGGCCTGCATCTTTCTGAAGCCATTGCGGCGTTGATGACTGGATACGCT
GAGCGCCCGGCGCTCGGTGAGCGCGCACGCGAGTTGGTCACCGACCAGGATGGCCGCACC
ACGCTGCGCCTGTTGCCACGCTTCGACACCACCACATACGGCGAATTATGGTCCCGCACA
ACATCAGTCGCCGCTGCATGGCACCACGACGCCGCCCACCCGGTTAAGGCCGGCGATCTG
GTGGCCACCCTGGGATTCACCAGCATCGACTACACCGTGCTGGATCTGGCGATCATGATC
CTCGGTGGCGTGGCGGTTCCGCTACAGACCAGCGCCCCGGCTTCGCAGTGGACGACCATT
CTGGCCGAAGCGGAACCCAACACTCTTGCGGTAAGCATCGAATTGATCGGCGCTGCAATG
GAATCTGTGCGGGCCACGCCTTCCATCAAGCAGGTCGTCGTGTTCGACTACACCCCCGAG
GTCGATGATCAACGGGAGGCATTCGAGGCAGCAAGCACACAACTCGCCGGCACCGGCATC
GCCATTGAGACCCTCGATGCCGTCATCGCCCGCGGCGCCGCACTTCCGGCCGCACCGCTC
TACGCACCATCGGCCGGCGACGATCCGCTGGCGCTGCTCATCTACACCTCCGGCAGCACC
GGGGCTCCAAAGGGCGCCATGCACAGCGAAAACATCGTGCGCCGCTGGTGGATTCGTGAG
GACGTCATGGCCGGCACCGAGAACCTGCCCATGATCGGGCTGAACTTCATGCCGATGAGT
CACATCATGGGACGCGGCACCCTCACCTCCACCCTGTCTACCGGTGGAACCGGATACTTC
GCGGCGTCCAGTGACATGTCAACGCTCTTCGAGGACATGGAGCTGATCCGCCCGACGGCC
CTGGCCTTGGTTCCACGCGTGTGCGACATGGTGTTCCAGCGATTCCAGACCGAGGTGGAC
CGGCGTCTGGCGAGCAGCGACACCGCCAGTGCCGAGGCCGTTGCGGCCGAGGTCAAGGCC
GATATCCGTGACAACCTCTTCGGTGGCCGCGTATCGGCGGTCATGGTCGGTTCTGCTCCG
TTGTCCGAGGAGCTGGGTGAGTTCATCGAATCCTGCTTCGAGCTGAATCTGACCGATGGC
TACGGCTCCACCGAAGCCGGCATGGTGTTCCGCGACGGCATCGTGCAACGCCCGCCGGTC
ATTGACTACAAGCTGGTTGACGTGCCCGAACTGGGCTACTTCTCCACCGACAAGCCGCAC
CCGCGCGGTGAGCTGCTGCTGAAGACCGACGGCATGTTCCTCGGGTACTACAAACGCCCC
GAGGTGACTGCCGGCGTCTTCGACGCGGACGGTTTTTACATGACCGGCGACATCGTCGCC
GAGCTGGCCCACGACAACATCGAGATCATCGATCGCCGCAACAACGTGCTCAAACTCTCA
CAGGGAGAGTTTGTCGCGGTCGCCACCTTGGAGGCCGAGTACGCCAATAGCCCTGTGGTG
CACCAGATCTACGTCTACGGCAGCAGCGAACGGTCCTACCTGCTAGCAGTCGTGGTGCCG
ACGCCGGAGGCCGTGGCCGCCGCCAAGGGCGACGCGGCGGCACTCAAGACGACCATCGCG
GACTCGCTGCAGGACATTGCCAAGGAGATCCAGCTGCAGTCCTACGAAGTCCCCCGTGAC
TTCATCATCGAACCGCAGCCATTCACCCAGGGCAACGGCCTGCTGACGGGTATCGCCAAG
CTGGCGCGTCCGAACCTGAAGGCGCACTATGGACCGCGGCTGGAGCAGATGTACGCCGAA
ATCGCCGAGCAGCAGGCTGCCGAGCTTCGGGCGTTGCACGGAGTGGACCCAGACAAGCCC
GCGCTGGAAACGGTCCTCAAGGCGGCGCAGGCCCTGCTCGGCGTCTCGTCGGCCGAACTG
GCCGCGGACGCGCATTTCACCGATCTAGGTGGCGATTCGCTGTCCGCACTGTCCTTCTCG
GATCTGCTGCGCGATATCTTCGCGGTCGAAGTACCGGTCGGAGTCATCGTCAGTGCCGCA
AACGATCTCAGCGGTGTTGCGAAATTTGTTGATGAACAACGCTATTCGGGCGGGACGCGG
CCGACCGCGGAGACGGTGCACGGCGCCGGGCATACGGAGATCCGGGCCGCGGACCTGACC
CTGGATAAGTTCATCGACGAGGCCACCCTGCATGCGGCACCGTCGCTTCCGAAGGCCGTC
GGGATCCCACACACCGTCCTGCTCACCGGGTCCAACGGCTACCTGGGCCACTACCTGGCA
CTGGAATGGCTTGAGCGCCTGGACAAGACAGAAGGCAAGCTGATCGCCATCGTCCGCGGT
AAGAATGCCGAGGCCGCCTACCGCCGCCTCGAGGAAGCCTTCGACACCGGCGACACGCAG
CTGTTGGCGCACTTCCGGTCGCTGGCCGACAAGCACCTCGAAGTACTGGCCGGCGATATC
GGCGACCCCAACCTTGGCCTGGATGCCGACACCTGGCAGCGCCTGGCCGACACCGTCGAC
GTCATCGTGCACCCCGCCGCCCTGGTCAACCACGTACTGCCCTACAGCCAGCTGTTCGGA
CCGAATGTCGTCGGCACCGCCGAGATCATCAAGCTGGCCATCACTACCAAGATCAAGCCG
GTCACCTACCTGTCCACGGTCGCGGTCGCGGCATATGTCGATCCGACGACATTCGACGAA
GAGTCCGATATCCGGCTCATCAGCGCGGTGCGTCCCGTGGACGAGCTGTACGCGAACGGC
TACGGCAACAGCAAGTGGGCCGGCGAGGTACTGCTGCGCGAAGCCCACGATCTGTGCGGA
CTACCCGTCGCGGTCTTCCGCTCCGACATGATCTTGGCCCACAGCCGCTACACCGGACAG
CTCAACGTGCCCGACCAGTTCACCCGACTAATCCTCAGCCTCATCGCCACCGGAATCGCA
CCCGGCTCCTTCTACCAAGCACACGCCACCGGCGAACGCCCACTCGCCCACTACGACGGG
CTACCCGGTGACTTCACCGCCGAGGCGATCACCACGTTGGGCACCCAGGTGGTCGACAGC
TACGAGACCTACGACTGCGTGAACCCGCATGCAGACGGAGTCTCGCTGGACAACTTCGTC
GACTGGCTCATCGAAGCCGGCTACCCCATCGCACGCATCGACAACTACACCGAATGGTTC
ACCCGCTTCGACACCGCCATCCGAAGCCTCCCCGAAAAACAGAAACAACACTCCCTACTA

FIG. 4 (Cont.)

CCACTGCTCCACGCATTCGAACAGCCGTCCGCCGCCGAGAACCACGGCGTCGTCCCGGCA
AAGCGTTTCCAGCACGCTGTGCAGGCCGCCGGAATCGGTCCGGCCGGGCAAGACGGCACT
ACCGACATTCCCCACCTGTCGCGGCGGCTGATCGTGAAATACGCCAAGGACCTCGAACAG
CTCGGACTCCTATGA

Amino acid sequence (SEQ ID NO:60)

>uniprot|B1MCR9|B1MCR9_MYCAB Probable fatty-acid-CoA ligase FadD

MTVTNETNPQQEQLSRRIESLRESDPQFRAAQPDPAVAEQVLRPGLHLSE
AIAALMTGYAERPALGERARELVTDQDGRTTLRLLPRFDTTTYGELWSRT
TSVAAAWHHDAAHPVKAGDLVATLGFTSIDYTVLDLAIMILGGVAVPLQT
SAPASQWTTILAEAEPNTLAVSIELIGAAMESVRATPSIKQVVVFDYTPE
VDDQREAFEAASTQLAGTGIAIETLDAVIARGAALPAAPLYAPSAGDDPL
ALLIYTSGSTGAPKGAMHSENIVRRWWIREDVMAGTENLPMIGLNFMPMS
HIMGRGTLTSTLSTGGTGYFAASSDMSTLFEDMELIRPTALALVPRVCDM
VFQRFQTEVDRRLASSDTASAEAVAAEVKADIRDNLFGGRVSAVMVGSAP
LSEELGEFIESCFELNLTDGYGSTEAGMVFRDGIVQRPPVIDYKLVDVPE
LGYFSTDKPHPRGELLLKTDGMFLGYYKRPEVTAGVFDADGFYMTGDIVA
ELAHDNIEIIDRRNNVLKLSQGEFVAVATLEAEYANSPVVHQIYVYGSSE
RSYLLAVVVPTPEAVAAAKGDAAALKTTIADSLQDIAKEIQLQSYEVPRD
FIIEPQPFTQGNGLLTGIAKLARPNLKAHYGPRLEQMYAEIAEQQAAELR
ALHGVDPDKPALETVLKAAQALLGVSSAELAADAHFTDLGGDSLSALSFS
DLLRDIFAVEVPVGVIVSAANDLSGVAKFVDEQRYSGGTRPTAETVHGAG
HTEIRAADLTLDKFIDEATLHAAPSLPKAVGIPHTVLLTGSNGYLGHYLA
LEWLERLDKTEGKLIAIVRGKNAEAAYRRLEEAFDTGDTQLLAHFRSLAD
KHLEVLAGDIGDPNLGLDADTWQRLADTVDVIVHPAALVNHVLPYSQLFG
PNVVGTAEIIKLAITTKIKPVTYLSTVAVAAYVDPTTFDEESDIRLISAV
RPVDELYANGYGNSKWAGEVLLREAHDLCGLPVAVFRSDMILAHSRYTGQ
LNVPDQFTRLILSLIATGIAPGSFYQAHATGERPLAHYDGLPGDFTAEAI
TTLGTQVVDSYETYDCVNPHADGVSLDNFVDWLIEAGYPIARIDNYTEWF
TRFDTAIRSLPEKQKQHSLLPLLHAFEQPSAAENHGVVPAKRFQHAVQAA
GIGPAGQDGTTDIPHLSRRLIVKYAKDLEQLGLL

YP 001703695.1

Nucleotide sequence (SEQ ID NO:61)

>uniprot|B1MCS0|B1MCS0_MYCAB Probable fatty-acid-CoA ligase FadD

ATGACGATCGACGCCACCGCGGACAACACCAAGGAAGCACGTCGTCAGCGGTTAGGCGAC
CGCATCAGGCGCCTATTCACCGACGATGAGCAGTTCCGTGCCGCCAAGCCCGATACCGCG
GTTGATACCGCCGTCGCCCAGCCTGGTCTGCGTCTCGCCCAGGTGGTCGCCACGATCATG
AACGGGTACGCGGACCGTCCGGCGCTCGGGCACCGAGTCCAGGAGCTCGTCGCCGACGCC
GCCGGCCGTTCGACGCTGCGCCCGTTGCCCGAGTTCGAGACGGTCACCTACGGAGAGCTG
TGGGGCATGGCCCGCGCGTTGGCCTCCACCTGGTACCACGATCCCGCCGCTCCGGTACGG
GCCGGGGACTTCGTCGCGATGCTCGGCTTCACCAGCGTGGACTACACCGCTGTCGACTTG
GCATGCATCCACCTTGGCGCGGTGGCGGTTCCATTGCAGACCAGCGCATCGGCATCCAAC
TGGACCGCGATCCTGGCCGAATCGGAACCTGCCGTCCTGGCGGTAAGCGCCGAGTTGCTC
GATACGGCAATGGAATCGGTGCTCGCCACGCCGTCGCTGCGGCACATCACCGTCTTTGAC
TATCATCCCGGTGTCGACGTGCAGCGCGAAAGTCTCGAATCCGCACAGCACCGGATCGCC
GAGGCCGGCCTGCCGATTTCGGTAGACCCGATACCCCTGGCGATCGGGCACGGGCGCGCC

FIG. 4 (Cont.)

TTGCCGGATGCGCCGTTGTTCACCGCAGAGGAGGGTACCGACCCGCTGGCCCTGGTGATC
TACACCTCGGGAAGCACCGGAACTCCCAAGGGCGCCACCTATAGCGAAAAGATGGTCGCC
AAGCCCTGGCTGCGGGCCGACACGTTGAGCTCTAAGGCCGAAATTCCTTTGATCAACCTG
AATTTCATGCCAATGAGCCATGTGATGGGACGCGGTAGTCTGGTCACTGCCCTGGCCTGC
GGCGGCCTGGCTTACTTTGCCGCGTCCAGCGACATGTCCACGCTGTTCGAAGACATCACG
CTTACGCGCCCCACCGTGGTGACACTCGTGCCCCGTGTGTGCGACATGCTTTTCCAGCGC
TACCGCAACGAGGTTGAACGCCGTACCGGGCTTGATCCGGCGGCCGACCTGGCCACCCTT
GATGCCGATGTCAAGACCGATATCCGCGAAAACCTGTTCGGCGGGCGTGTTCTGACAATC
GTGTGCGGCTCTGCCCCACTGTCCGAGGAACTGGCCGCCTTCATCGAATCCTGCCTCGAT
GCCCGTATCACCGATGGCTACGGCTCCACCGAGGCGGGCGTCATCGTGCGCAACGGCCGC
ATTCAGCGCCCGCCCGTCATCGACTACAAGCTGGTCGACGTGCCTGAGCTCGGTTACTTC
TCCACCGACAAGCCGCACCCGCGCGGCGAGCTGCTCGTGAAAGCCGAATCGGTGTTCGGC
GGCTACTTCAAACGCCCCGACGTCACCGCCGACGTATTCGATCCCGACGGGTACTACAAG
ACCGGGGACATCGTCGCCGAGCTCGAGCCCGACAAGATCCAGATCGTGGACCGGCGCAAC
AACGTGATCAAGCTGTCCCAGGGTGAGTTCGTGGCGATCGCCAACCTGGAAGCCGAGTTC
GCCAATAGTCCACTGGTGCATCAGATCTGCGTCTACGGCAGCAGCGAGCGGTCGTATCTG
CTAGCGGTGGTCGTGCCGACCGCTGAGGCATATGAACAAAGCGGTGGAGATGAGGATCTA
CTCAAACGCCTGATCGCGGACTCTCTCGCGCAGGTTGCCCGCGAGGCCCAACTGCAGTCC
TACGAGGTACCGCGCGACTTCCTGCTGGAGACCGAACCGTTCACCGCTGCCAACGGCCTA
CTGACCGGCATCGCGAAGCTGGCCCGACCGAAGCTCCATGAGAAGTACGGCGCCCGCCTG
GAGCAGCTGTACTCCGATATCGCCGCCGCCCAGGCGCTTGAGCTGCAAGCACTGCACTCT
GCCGGACATGAGGACAAGCCTGTCCTGGATACCGTGCAACGCGCGGTCACGGCGTTGTTG
GGGCTGTCGGCGGCCGAGGTGAGCCCAGACGCGCATTTCATCGACCTTGGTGGCGATTCA
CTATCCGCCCTTGCCTTCTCGGACCTGCTGCGCGATATCTTCACTGTGGAGGTTCCGGTT
GGCGATATCGTCAGCGCCGCCAACGATCTGACCGCTATCGCACGCATCGTGGAAAGACAC
CGGGAAGCAGACGGTCATTCGGTAACTCCCACCGCCGAATCCGTGCACGGTGCCGGGCAC
CGCGAGATCCGGGCCGCGGACCTGACGCTGGACAAGTTCATCGACGCGGACACCCTGCGC
GCGGCCCCGGCACTGTCCACATTCACCGGCACCCCGCACACGGTGCTGCTCACCGGCGCC
AACGGCTACCTGGGGCGGTTCCTGGCCCTGGAATGGCTTGAGCGCCTGGACAAGACAGAC
GGCAAGCTGATCGCCATCGTCCGCGGTAAGAATGCCGAGGCCGCCTACCGCCGCCTGGAG
GAAGCCTTCGACACCGGCGACACGCAGCTGTTGGCGCACTTCCGGTCGCTGGCCGACAAG
CACCTCGAAGTACTGGCCGGCGATATCGGCGACCCCAACCTTGGCCTGGATGCCGACACC
TGGCAGCGCCTGGCCGAGACCGTCGACGTCATCGTGCACCCCGCCGCCCTGGTCAACCAC
GTACTGCCCTACAGCCAGCTGTTCGGACCCAATGTCGTTGGCACCGCCGAAATCATCAAG
CTGGCACTCACCACCAAGATCAAGCCCATCACCTACCTCTCCACAGTGGCCGTGGCAATC
TCGGTGGACCCCAAGGTATTCGATGAAGACTCCGACATCCGCACGATCAGCGCGGTACGA
CCAATCAACGACGGCTACGCCAACGGATACGGCAACGCGAAATGGGCTGGCGAGGTACTG
CTGCGCGAAGCCCACGACCTGTGCGGACTACCCGTCGCGGTCTTCCGCTCCGACATGATC
TTGGCCCACAGCCGCTACACCGGACAGCTCAACGTGCCCGACCAGTTCACCCGACTAATC
CTCAGCCTCATCGCCACCGGAGTCGCACCCGGCTCCTTCTACCAAGCACACGCCACCGGC
GAACGCCCACTCGCCCACTACGACGGCCTGCCTGCGGATTTCACGGCATCGGCCATCACC
GCCCTCGGGCCCATCGAGGAGTTCCACACCTACGATTCGGTGAACCCGCATGCCGATGGG
ATCTCGCTGGACAACTTCGTCGACTGGCTCATCGAAGCCGGCTACCCCATCGCACGCATC
GACAACTACACCGAATGGTTCACCCGCTTCGACACCGCCATCCGAAGCCTCCCCGAAAAA
CAGAAACAACACTCCCTACTACCACTACTACACGCGTACAGGCATCCACAACACCCACAC
AACGGCGCATTCCTGCCCGCGATCAGGTTCAGTGAAGGCGTCCAGGCCCATCTGAACGCC
GACATCCCGCACCTCACGCGGGAACTCATCGCGAAATACGCGGCCGACCTGAAGCAGCTC
GGGTTACTCTAG

FIG. 4 (Cont.)

Amino acid sequence (SEQ ID NO:62)

>uniprot|B1MCS0|B1MCS0_MYCAB Probable fatty-acid-CoA ligase FadD

MTIDATADNTKEARRQRLGDRIRRLFTDDEQFRAAKPDTAVDTAVAQPGL
RLAQVVATIMNGYADRPALGHRVQELVADAAGRSTLRPLPEFETVTYGEL
WGMARALASTWYHDPAAPVRAGDFVAMLGFTSVDYTAVDLACIHLGAVAV
PLQTSASASNWTAILAESEPAVLAVSAELLDTAMESVLATPSLRHITVFD
YHPGVDVQRESLESAQHRIAEAGLPISVDPIPLAIGHGRALPDAPLFTAE
EGTDPLALVIYTSGSTGTPKGATYSEKMVAKPWLRADTLSSKAEIPLINL
NFMPMSHVMGRGSLVTALACGGLAYFAASSDMSTLFEDITLTRPTVVTLV
PRVCDMLFQRYRNEVERRTGLDPAADLATLDADVKTDIRENLFGGRVLTI
VCGSAPLSEELAAFIESCLDARITDGYGSTEAGVIVRNGRIQRPPVIDYK
LVDVPELGYFSTDKPHPRGELLVKAESVFGGYFKRPDVTADVFDPDGYYK
TGDIVAELEPDKIQIVDRRNNVIKLSQGEFVAIANLEAEFANSPLVHQIC
VYGSSERSYLLAVVVPTAEAYEQSGGDEDLLKRLIADSLAQVAREAQLQS
YEVPRDFLLETEPFTAANGLLTGIAKLARPKLHEKYGARLEQLYSDIAAA
QALELQALHSAGHEDKPVLDTVQRAVTALLGLSAAEVSPDAHFIDLGGDS
LSALAFSDLLRDIFTVEVPVGDIVSAANDLTAIARIVERHREADGHSVTP
TAESVHGAGHREIRAADLTLDKFIDADTLRAAPALSTFTGTPHTVLLTGA
NGYLGRFLALEWLERLDKTDGKLIAIVRGKNAEAAYRRLEEAFDTGDTQL
LAHFRSLADKHLEVLAGDIGDPNLGLDADTWQRLAETVDVIVHPAALVNH
VLPYSQLFGPNVVGTAEIIKLALTTKIKPITYLSTVAVAISVDPKVFDED
SDIRTISAVRPINDGYANGYGNAKWAGEVLLREAHDLCGLPVAVFRSDMI
LAHSRYTGQLNVPDQFTRLILSLIATGVAPGSFYQAHATGERPLAHYDGL
PADFTASAITALGPIEEFHTYDSVNPHADGISLDNFVDWLIEAGYPIARI
DNYTEWFTRFDTAIRSLPEKQKQHSLLPLLHAYRHPQHPHNGAFLPAIRF
SEGVQAHLNADIPHLTRELIAKYAADLKQLGLL

<u>YP 001704097.1</u>

Nucleotide sequence (SEQ ID NO:63)

>uniprot|B1MDX4|B1MDX4_MYCAB Putative fatty-acid-CoA ligase

ATGACGGCTGGTGCGGCGGCTCGCGTTGCCAAACTGTTCGAGTCCGATCCCCAATTCCGG
GCAGCCATGCCGGATCCAGCGGTGATGGACTCGCTGCTGGCGCCCGGCCTGCGTTTATCC
CAGGTACTCCACGCGTTGCTCAGCGGTTACGCGGAGCGCCCGGTGATGGGTTTCCGGTCC
CGCGAGTCGGTGGTCGACACCGCCACCGGCCGCACGGTCGACCGGCTGCTCCCTGCCTTT
GAAACCATCACCTATGGGCAACTCCTGGAAGACATCTCGGCCATCCTCGCGGAGTGGCAG
CATGGCGACATTCCCATGGGCGCCGGCGACTTCATCGCCACCATCGGCTTCTCCAGTCCC
GACTACGTCACCCTGGATCTGGCCACCCTCATGAATGGTTCGGTCTCGATCCCACTGCAG
CACAACACATCTGTGGCGCAGCTGCGGATGATGCTGGAGGAGACCAGCCCACGCCTGGTG
GCGGCGAGCGCGGACTGCCTGGATCTCGCGGTCGAGGCAGCTGTCGGGCTTACCGATCTG
CGACGGGTTGTGGTGTTCGATTACCGCGCCGAGACCGACGATCATCGCGAAAAACTGGCC
ACGGCAAGAGAACGCTTGCACGCGGCCGGTATGGACGTTGTAGTCGAACCGCTCGCAGAG
GTGATCGGGAGAGGACGAGACCTACCCGAACCCGTGCTGTACACGGCCGGGGACGATCAG
CGCACGGCCCTGATCATGTACACCTCCGGTAGCACCGGCGCGCCCAAGGGGGCGATGTTC
ACCGAGTGGACGGTGACCCGCTTCTGGTCCTCGGGCGCCGCCCCCAACCGGGACACCCCG
ATCATCAACGTGAACTTCCTGCCGCTCAACCACCTTGCGGGCCGGGTAGGACTGCTGACG
GCCTTCATTCCCGGCGGCACATGCTACTTCGTCCCCGAGAGCGATCTGTCCACCCTGTTC
GAGGACTGGCAGCTGGCACGGCCCACCCATATGGGTGTGGTTCCCCGTGTCGTCGACATG

FIG. 4 (Cont.)

```
CTCTTCCAGCACTACCAAACGCGAGTGGACGCACTGATGGCCGGGGGAACCGACGTCGAC
ACCGCCGATCGGCTAGCCAAAACCGAACTGCGCGAAGATGTCCTGGGCGGGCGTGTGGTC
GCCGGCATGCTCGCCACCGCGCCGTTGTCCCCCGAGATGAAGGCTTTCCTGGAGTCCTCA
TTGGACTTTCATCTGCTTGATCTGTACGGCCTGACCGAGGTCGGCGGCGTGTTCCGAGAC
GGCAAGATTTCCCGGCCGCCGGTGCTCGACTACAAGCTCGTCGATGTTCCTGAGCTCGGG
TACTACACCACCGACAAGCCCCATCCGCGTGGCGAATTGCTGGTCAAGAGTGCCACCGCA
ACGCCCGGCTACTACAAGCGTCCCGACGTCACCGCCGAGGTGTTCGACGCCGATGGCTAC
TACCGCACGGGCGATGTCATGGCGGAGGTCGCGCCGGACCAATTGGTGTACGTGGACAGG
CGCAATAACGTCATCAAGCTCGCCCAGGGCGAGTTCGTCGCGGTCGCCAATTTGGAAACG
GTCTATGTGGGTGCGCCGCTGGTGCGCCAGATCTTCGTCTACGGCAACAGCGAACGCGCA
TACCTCCTCGCCGTTGTGGTGCCCACCGAGGAAGCCCTGCGGGCACACCCGGACCCCGTC
GAACTGAAGAATTCGATCCGGGAGTCACTGCAGCGGACCGCCCGCTCCAACCACCTGCAT
TCCTACGAGCTGCCCGCCGACTTCATTATCGAAACCACTCCATTCACGATCGAGAGTGGG
ATGCTTGCGGCTGTCGGTAAGCCGATACGTCCCAAGATGATCGAGCACTACGGCGACCGG
CTCGAGCAGCTCTACGTCGACCTCGCCGAGGCACGCGTCCAGGAACTGCGGCAGCTCCGC
GATACGGCGCAACAACGCCCGGTCCTCGATACCGTCACCGAGGCCGCCCAGGCCCTCCTC
GGCATGTCTGCGGACGCCGTCCGTCCCGACCACCACTTCATCGACCTCGGCGGAGATTCG
CTGTCCGCGTTGACATTCTCCAATCTTCTTCGAGACCTCTTCGACGTCGAGGTTCCGGTC
GGTGTGATCACCGGCCCGGCGGCCGATCTGCGCAAGCTCGCCGCTTACATCCAGCACGAA
CGGGAGCACAGCACCGCGACCGCTGCCAGCGTGCACGGGCTCGACACCACCGTCATCAGC
GCCACCGAACTGACACTCGACAAGTTCATCGACGCCGAGACACTCCACAACGCTTCGCAA
CTCGACGTGCCGGCGGGCGCGGTAGCTACCGTTCTGCTCACCGGCGCCAACGGATATCTC
GGAAGATTCCTCTGCCTGGAGTGGCTGCAACGGCTGTCCCAGACAGGTGGACAACTGATC
TGCCTGGTCCGCGGCGACAACGCCGATCAAGCCCTCGCGCGCCTCGTTGCCGCCTACGGC
GACACCGATCGCACACTGCTCGAGGAGTTCCACACCCTGGCTCGACGGCACCTGCGCGTG
ATCGCCGCCGATATCGCTCAGCCGCGCTTCGGCGTGGATGACGCCACCTGGGAGCAGCTG
GCCCGCGATGTCGACAAGATCGTGCATCCGGCCGCGCTGGTCAACCACGTGCTGCCCTAC
AACCAGCTGTTCGGCCCCAATGTGTTTGGCACGGCGGAGGTTATCCGGCTGGCCCTGACC
ACCCGGATCAAGCCGGTGACCTATCTGTCGACGATGGCCGTGGCCATGACCGTGCCCGAT
TTCGACGAGGACGGGGACATCCGCACGGTGAGTCCCACCCGGCATATCGACCCCGGCTAC
GCCAACGGGTACGCCAACAGCAAATGGGCCGGCGAGGTGCTGCTGCGGGAGGCACACGAC
ATATGCGGCCTGCCGGTCAGCGTGTTCCGGTCCGACATGATCCTGACGCACCGCCGTTAC
AGCGGACAACTCAACGTCACCGACGCCTTCACCCGCATGCTGCTGAGCCTGGTGCTCACC
GGCATCGCGCCGCGAAGCTTTTACCAAGGCGATGGCAGCGGTGCCCGCCCACGCGCTCAC
TACGAGGGGCTGCCGGTCGATTTCGTCACCGAAGCCATTACCAGCCTCGGCCTGTCCTCG
TCCGAGGGATTTCGCTCGTACGACGTCATGAATCCTCACGATGACGGCATTTCTGTGGAC
ACCTTTGTCGACTGGCTCATGGAAGATGGGCATTCCATCGACATCATCGACAACTACGAC
GAATGGCTGTCCCGTTTCGAGACGGCATTGCGAGGTCTGCCCGACGAGCAGCGGCGCGCC
TCAGTACTTCCGCTCCTCGATGCGTATCGGATACCGGGCAACCCGCGCCGTGCTGCCGCC
ACGCCCAATCATGTATTCCGGAAAGCCGTACAGGAGAACAACATCGGAGGTGACGGCGCC
GATATTCCGCAAATCGATCGTGCGCTGATCGCCAAATACATCGCCGATCTACGAGCACAC
AGGCTGCTGTGA
```

Amino acid sequence (SEQ ID NO:64)

>uniprot|B1MDX4|B1MDX4_MYCAB Putative fatty-acid-CoA ligase

MTAGAAARVAKLFESDPQFRAAMPDPAVMDSLLAPGLRLSQVLHALLSGY
AERPVMGFRSRESVVDTATGRTVDRLLPAFETITYGQLLEDISAILAEWQ
HGDIPMGAGDFIATIGFSSPDYVTLDLATLMNGSVSIPLQHNTSVAQLRM
MLEETSPRLVAASADCLDLAVEAAVGLTDLRRVVVFDYRAETDDHREKLA
TARERLHAAGMDVVVEPLAEVIGRGRDLPEPVLYTAGDDQRTALIMYTSG
STGAPKGAMFTEWTVTRFWSSGAAPNRDTPIINVNFLPLNHLAGRVGLLT

FIG. 4 (Cont.)

AFIPGGTCYFVPESDLSTLFEDWQLARPTHMGVVPRVVDMLFQHYQTRVD
ALMAGGTDVDTADRLAKTELREDVLGGRVVAGMLATAPLSPEMKAFLESS
LDFHLLDLYGLTEVGGVFRDGKISRPPVLDYKLVDVPELGYYTTDKPHPR
GELLVKSATATPGYYKRPDVTAEVFDADGYYRTGDVMAEVAPDQLVYVDR
RNNVIKLAQGEFVAVANLETVYVGAPLVRQIFVYGNSERAYLLAVVVPTE
EALRAHPDPVELKNSIRESLQRTARSNHLHSYELPADFIIETTPFTIESG
MLAAVGKPIRPKMIEHYGDRLEQLYVDLAEARVQELRQLRDTAQQRPVLD
TVTEAAQALLGMSADAVRPDHHFIDLGGDSLSALTFSNLLRDLFDVEVPV
GVITGPAADLRKLAAYIQHEREHSTATAASVHGLDTTVISATELTLDKFI
DAETLHNASQLDVPAGAVATVLLTGANGYLGRFLCLEWLQRLSQTGGQLI
CLVRGDNADQALARLVAAYGDTDRTLLEEFHTLARRHLRVIAADIAQPRF
GVDDATWEQLARDVDKIVHPAALVNHVLPYNQLFGPNVFGTAEVIRLALT
TRIKPVTYLSTMAVAMTVPDFDEDGDIRTVSPTRHIDPGYANGYANSKWA
GEVLLREAHDICGLPVSVFRSDMILTHRRYSGQLNVTDAFTRMLLSLVLT
GIAPRSFYQGDGSGARPRAHYEGLPVDFVTEAITSLGLSSSEGFRSYDVM
NPHDDGISVDTFVDWLMEDGHSIDIIDNYDEWLSRFETALRGLPDEQRRA
SVLPLLDAYRIPGNPRRAAATPNHVFRKAVQENNIGGDGADIPQIDRALI
AKYIADLRAHRLL

YP 001705436.1

Nucleotide sequence (SEQ ID NO:65)

>uniprot|B1MLD7|B1MLD7_MYCAB Probable fatty-acid-coa ligase FadD

ATGACTGAAACGATCTCCACAGCGGCTGTCCCCACTACGGATCTCGAAGAGCAGGTGAAG
CGACGCATCGAGCAGGTCGTGTCCAACGATCCGCAGCTGGCGGCGCTTCTCCCGGAAGAT
TCGGTCACCGAGGCGGTCAACGAGCCCGATCTACCGCTGGTCGAGGTGATCAGGCGACTG
CTGGAGGGCTACGGTGACCGCCCGGCACTCGGCCAGCGCGCCTTCGAGTTCGTCACCGGG
GACGACGGTGCGACCGTGATCGCGCTGAAGCCCGAATACACCACCGTCTCCTACCGCGAG
TTGTGGGAACGTGCCGAGGCTATCGCTGCCGCGTGGCACGAGCAGGGCATCCGTGACGGC
GACTTCGTCGCTCAGTTGGGTTTCACCAGCACGGACTTCGCGTCGCTCGACGTCGCGGGA
TTGCGTCTGGGCACCGTCTCGGTGCCCCTGCAGACGGGCGCGTCGCTGCAGCAGCGCAAC
GCGATTCTCGAAGAGACCCGGCCCGCAGTCTTTGCCGCGAGTATCGAATACCTTGATGCC
GCCGTCGATTCGGTGCTTGCGACCCCCTCGGTGCGACTCCTCTCGGTTTTCGACTATCAC
GCGGAGGTCGACAGCCAGCGCGAAGCGCTGGAGGCTGTGCGGGCCCGGCTTGAGAGTGCC
GGCCGGACGATCGTCGTCGAGGCCCTGGCGGAGGCTCTCGCGCGGGGGCGGGACCTGCCC
GCCGCGCCGCTGCCCAGTGCAGATCCCGATGCCTTGCGTCTGCTCATCTACACCTCCGGC
AGCACCGGTACCCCCAAGGGCGCCATGTATCCGCAATGGCTGGTCGCCAACTTGTGGCAG
AAGAAGTGGCTCACCGACGATGTGATTCCGTCCATAGGCGTGAACTTCATGCCCATGAGC
CACCTGGCGGGTCGCCTCACTCTCATGGGCACCCTTTCCGGTGGCGGAACCGCCTACTAC
ATCGCTTCGAGCGATCTTTCGACTTTCTTCGAGGACATCGCGCTCATCCGCCCCTCCGAA
GTGCTCTTCGTGCCGCGTGTGGTGGAGATGGTGTTCCAGCGTTTTCAGGCAGAATTGGAC
CGGTCCCTTGCCCCGGGTGAGAGCAACTCCGAGATCGCGGAGCGAATCAAGGTCCGCATC
CGGGAACAGGACTTCGGCGGGCGTGTGCTCAGTGCTGGCTCCGGGTCGGCCCCGTTGTCT
CCTGAGATGACGGAGTTCATGGAGTCGCTGCTGCAGGTGCCGTTGCGCGACGGGTATGGG
TCCACCGAGGCCGGTGGTGTGTGGCGTGACGGAGTCCTGCAGCGTCCGCCCGTCACCGAC
TACAAGCTGGTTGACGTTCCGGAACTCGGATACTTCACCACAGATTCGCCGCATCCCCGT
GGCGAGCTGCGGTTGAAGTCGGAGACGATGTTCCCCGGCTACTACAAGCGCCCGGAGACC
ACTGCCGATGTCTTCGATGACGAGGGGTACTACAAGACCGGTGACGTGGTCGCCGAGCTC
GGGCCGGATCACCTCAAGTACCTCGACCGCGTCAAGAACGTCCTCAAGCTCGCGCAGGGA
GAGTTTGTCGCGGTGTCAAAGCTGGAGGCCGCTTACACCGGCAGCCCGCTGGTCCGGCAG
ATCTTTGTGTACGGGAACAGTGAACGCTCGTTCCTGCTGGCTGTCGTGGTCCCGACACCC

FIG. 4 (Cont.)

GAAGTCCTTGAGCGGTACGCAGATTCGCCAGATGCGCTCAAGCCCTTGATCCAGGATTCG
CTGCAGCAGGTCGCCAAGGACGCGGAGCTGCAATCCTATGAGATACCGCGCGACTTCATC
GTTGAGACGGTGCCGTTCACCGTCGAGTCCGGATTGCTATCGGACGCGCGAAAGCTGCTG
CGCCCCAAGCTGAAGGATCACTACGGAGAGAGGCTGGAGGCGCTGTACGCCGAACTGGCG
GAAAGCCAGAATGAGCGGCTGCGCCAGTTGGCCAGGGAGGCAGCCACGCGCCCGGTCCTG
GAGACGGTGACCGATGCGGCCGCCGCGCTGCTGGGCGCATCGTCCTCGGATCTGGCTCCT
GATGTGCGATTCATCGACCTCGGTGGCGACTCACTGTCGGCGCTGTCGTACTCCGAGCTG
CTGCGCGACATCTTTGAGGTGGACGTTCCGGTGGGCGTCATCAACAGCGTCGCCAACGAC
CTTGCCGCGATCGCCCGGCACATCGAGGCGCAGCGGACCGGCGCCGCTACGCAGCCGACC
TTTGCGTCGGTCCACGGCAAGGACGCGACGGTCATCACCGCCGGTGAACTCACCCTCGAC
AAGTTCTTGGACGAGTCACTGTTGAAAGCGGCCAAGGACGTTCAGCCGGCAACGGCCGAT
GTCAAGACCGTTCTAGTGACCGGCGGCAACGGCTGGTTGGGTCGTTGGCTGGTGCTCGAT
TGGCTGGAGCGGTTGGCACCCAATGGTGGCAAGGTCTACGCCCTCATTCGTGGCGCCGAT
GCCGAAGCAGCCCGGGCACGGTTGGACGCCGTGTACGAATCGGGTGATCCCAAGCTGTCC
GCGCATTATCGTCAGCTGGCGCAACAGAGTCTGGAAGTTATCGCCGGCGATTTCGGCGAC
CAGGATCTCGGTCTATCCCAGGAAGTTTGGCAGAAGCTGGCCAAGGACGTGGACCTGATC
GTGCACTCCGGTGCCTTGGTGAACCACGTGCTGCCGTACAGCCAGTTGTTCGGTCCGAAT
GTGGCGGGTACCGCCGAGATCATCAAGCTGGCAATTTCGGAGCGGCTCAAGCCGGTCACC
TACCTGTCGACGGTGGCATCGCCGACCAGATTCCGGTGACGGAGTTCGAGGAAGACTCC
GATGTTCGTGTGATGTCGGCCGAGCGCCAGATCAATGACGGCTACGCGAACGGATACGGC
AACTCAAAATGGGCCGGCGAGGTGCTGTTGCGGGAGGCTCATGACCTAGCGGGGCTGCCG
GTGCGTGTGTTCCGCTCCGACATGATCCTGGCGCACAGTGACTACCACGGACAGCTCAAC
GTCACCGACGTGTTCACCCGGAGCATCCAGAGTCTGCTGCTCACCGGTGTTGCACCGGCC
AGCTTCTATGAATTGGATGCCGACGGCAATCGGCAGCGCGCTCACTATGACGGTGTGCCC
GGCGATTTCACCGCCGCATCGATCACCGCCATCGGCGGTGTGAACGTGGTAGACGGTTAC
CGCAGCTTCGACGTGTTCAACCCGCACCATGACGGTGTCTCGATGGATACCTTCGTCGAC
TGGCTGATCGACGCAGGCTACAAGATCGCGCGGATCGACGATTACGACCAGTGGCTCGCC
CGGTTCGAGCTGGCCCTCAAGGGATTGCCCGAGCAGCAGCGGCAACAGTCGGTGTTGCCA
CTTCTCAAGATGTACGAGAAGCCGCAACCGGCGATCGACGGAAGTGCACTTCCGACCGCA
GAATTCAGTCGCGCCGTGCACGAGGCGAAGGTCGGAGACAGCGGTGAGATACCGCACGTC
ACCAAGGAGCTGATCCTCAAGTACGCCAGCGATATTCAGCTGTTGGGCCTGGTGTAG

Amino acid sequence (SEQ ID NO:66)

>uniprot|B1MLD7|B1MLD7_MYCAB Probable fatty-acid-coa ligase FadD

MTETISTAAVPTTDLEEQVKRRIEQVVSNDPQLAALLPEDSVTEAVNEPD
LPLVEVIRRLLEGYGDRPALGQRAFEFVTGDDGATVIALKPEYTTVSYRE
LWERAEAIAAAWHEQGIRDGDFVAQLGFTSTDFASLDVAGLRLGTVSVPL
QTGASLQQRNAILEETRPAVFAASIEYLDAAVDSVLATPSVRLLSVFDYH
AEVDSQREALEAVRARLESAGRTIVVEALAEALARGRDLPAAPLPSADPD
ALRLLIYTSGSTGTPKGAMYPQWLVANLWQKKWLTDDVIPSIGVNFMPMS
HLAGRLTLMGTLSGGGTAYYIASSDLSTFFEDIALIRPSEVLFVPRVVEM
VFQRFQAELDRSLAPGESNSEIAERIKVRIREQDFGGRVLSAGSGSAPLS
PEMTEFMESLLQVPLRDGYGSTEAGGVWRDGVLQRPPVTDYKLVDVPELG
YFTTDSPHPRGELRLKSETMFPGYYKRPETTADVFDDEGYYKTGDVVAEL
GPDHLKYLDRVKNVLKLAQGEFVAVSKLEAAYTGSPLVRQIFVYGNSERS
FLLAVVVPTPEVLERYADSPDALKPLIQDSLQQVAKDAELQSYEIPRDFI
VETVPFTVESGLLSDARKLLRPKLKDHYGERLEALYAELAESQNERLRQL
AREAATRPVLETVTDAAAALLGASSSDLAPDVRFIDLGGDSLSALSYSEL
LRDIFEVDVPVGVINSVANDLAAIARHIEAQRTGAATQPTFASVHGKDAT
VITAGELTLDKFLDESLLKAAKDVQPATADVKTVLVTGGNGWLGRWLVLD
WLERLAPNGGKVYALIRGADAEAARARLDAVYESGDPKLSAHYRQLAQQS

FIG. 4 (Cont.)

LEVIAGDFGDQDLGLSQEVWQKLAKDVDLIVHSGALVNHVLPYSQLFGPN
VAGTAEIIKLAISERLKPVTYLSTVGIADQIPVTEFEEDSDVRVMSAERQ
INDGYANGYGNSKWAGEVLLREAHDLAGLPVRVFRSDMILAHSDYHGQLN
VTDVFTRSIQSLLLTGVAPASFYELDADGNRQRAHYDGVPGDFTAASITA
IGGVNVVDGYRSFDVFNPHHDGVSMDTFVDWLIDAGYKIARIDDYDQWLA
RFELALKGLPEQQRQQSVLPLLKMYEKPQPAIDGSALPTAEFSRAVHEAK
VGDSGEIPHVTKELILKYASDIQLLGLV

YP 001828302.1

Nucleotide sequence (SEQ ID NO:67)

>uniprot|B1VMZ4|B1VMZ4_STRGG Putative carboxylic acid reductase

ATGGCCGAACCGCTGGACGCCGCCACCGCGTCGGCGCACGATCCGGGCCAGGGGCTCGCC
GAGGCCCTGGCCGCCGTCGAACCGGGCCGGGCGCTCGCCGAGGTCATGGCGTCCGTCCTG
GAGGGCCACGGGGACCGGCCCGCCCTCGGCGAACGGGCCCGGGAGCCGGAGACCGGGCGT
CTCCTCCCGCACTTCGACACCATCAGCTACCGCGAACTGTGGTCCCGCGTCCGTGCGCTG
GCCGGCCGGTGGCACCACGACCCGGAATACCCCCTGGGCCCCGGCGACCGGATCTGCACC
CTCGGCTTCACCAGCACCGACTACGCGACGCTCGACCTGGCGTGCATCCACCTGGGGGCC
GTGCCCGTCCCCCTCCCGTCCAACGCCCCGCTGCCCCGACTGGCGCCGGTCGTCGAGGAG
TCCGGGCCGACGGTACTGGCCGCGAGCGTCGACCGGCTCGACACCGCCATCGACGTCGTC
CTCGCGTCGAGCACGATCCGCCGCCTCCTCGTCTTCGACGACGGCCCGGGGGCCACCCGC
CCGGGCGGGGCACTGGCGGCCGCCCGCCAACGCCTGTCCGGCAGCCCGGTCACCGTCGAC
ACCCTGGCCGGACTCATCGACCGGGGCAGGGACCTGCCGCCCCCGCCCCTGTACATCCCG
GACCCGGGGGAGGACCCGCTCGCCCTGCTCATCTACACCTCCGGCAGCACCGGCGCGCCC
AAGGGCGCCATGTACACCCAACGGCTCCTGGGCACCGCGTGGTACGGGTTCAGCTACGGG
GCGGCCGACACCCCCGCGATCAGCGTCCTCTACCTGCCGCAGAGCCACCTCGCGGGCCGC
TACGCGGTGATGGGATCGCTCGTGAAGGGGGGCACCGGCTACTTCACCGCTGCCGACGAC
CTGTCCACCCTGTTCGAGGACATCGCCCTGGTCCGCCCCACGGAGCTGACCATGGTCCCG
CGCCTGTGCGACATGCTCCTCCAGCACTACCGGAGCGAACGGGACCGCCGGGCCGACGAA
CCGGGCGACATCGAGGCGGCGGTCACGAAGGCGGTGCGGGAGGACTTCCTGGGCGGGCGC
GTCGCCAAGGCGTTCGTCGGCACCGCGCCGCTCTCCGCCGAACTCACGGCGTTCGTCGAG
TCCGTCCTCGGCTTCCACCTCTACACCGGCTACGGCTCCACCGAAGCCGGCGGAGTGCTG
CTGGACACGGTGGTGCAGCGCCCTCCGGTCACCGACTACAAACTGGTCGACGTCCCCGAA
CTGGGCTACTACGCGACCGACCTGCCCCATCCGCGCGGCGAACTGCTGCTGAAGTCCCAC
ACGCTCATCCCCGGCTACTACCGGCGCCCCGACCTCACCGCCGCGATCTTCGACGCGGAC
GGCTACTACCGCACCGGTGACGTCTTCGCCGAGACCGGACCCGACCGGCTGGTCTACGTC
GACCGCACGAAGGACACCCTGAAGCTGTCCCAGGGCGAGTTCGTGGCCGTGTCCCGCCTG
GAGACCGTCCTCCTCGACAGCCCTCTCGTCCAGCACCTCTACCTGTACGGCAACAGCGAG
CGCGCCTACCTCCTCGCGGTGGTGGTGCCCACCCCGGACGCGCTGGCCGGGTGCGGCGGG
GACACCGAGGCGCTCAGGCCGCTGCTCATGGAATCCCTCCGCAGCGTCGCCAGGAGGGCC
GGGCTCAACGCGTACGAGATCCCGCGCGGCATCCTCGTCGAGCCCGAGCCCTTCAGCCCG
GAGAACGGCCTCTTCACCGAGAGCCACAAACTGCTGCGCCCCCGCCTCAAGGAGCGCTAC
GGGCCCGCTCTGGAGCTGCTGTACGACCGACTGGCCGACGGGCAGGACCGCCGGCTGCGC
GAGCTGCGGCGCACCGGTGCGGACCGGCCGGTGCAGGAGACGGTCCTCCGGGCCGCCCAG
GCCCTGCTGGGATCCCCGGGCTCCGACCTCCGGCCCGGCGCGCACTTCACCGACCTCGGC
GGGGACTCCCTCTCCGCCGTCTCGTTCTCCGAGCTGATGAAGGAGATCTTCCACGTCGAC
GTCCCGGTCGGTGCGATCATCGGCCCGGCCGCCGACCTGGCGGAGGTGGCGCGGTACATC
ACGGCGGCCCGTCGGCCGGCCGGGGCACCGCGGCCCACGCCCGCCTCCGTGCACGGGGAG
CACCGCACCGAAGTCCGCGCCGGGGACCTCGCCCCGGAGAAGTTCCTCGACGCGCCCACG
CTCGCCGCCGCTCCGGCGCTGCCCCGCCCCGACGGCGACGTCCGGACGGTCCTGCTGACC
GGCGCCACCGGCTACCTCGGCCGGTTCCTCTGCCTGGAGTGGCTGGAGCGGCTGGCGCCC

FIG. 4 (Cont.)

TCGGGCGGACGGCTGGTCTGCCTCGTCCGCGGCAGCGACGCGACCGTCGCGGCGAGGCGG
CTGGAGGCAGCCTTCGACAGCGGCGACACCGCCCTGCTCCGGCGCTACCGGAAGGCGGCC
GGGAAGACCCTGGACGTGGTCGCGGGGGACATCGGCGAACCACTGCTGGGCCTGGCGGAG
GAGACCTGGCGGGAACTGGCCGGCGCCGTGGACCTGATCGTGCACCCGGCCGCGCTGGTC
AACCACCTGCTGCCGTACGGCGAACTGTTCGGCCCCAACGTCGTCGGCACCGCCGAAGCG
ATCCGGCTGGCGCTCACCACCCGGCTGAAGCCCGTCAACCACGTCTCGACCGTCGCGGTC
TGCCTCGGCACCCCCGCCGAGACGGCCGACGAGAACGCCGACATCCGGGCCGCCGTCCCG
GTACGGACCACCGGCCAGGGGTACGCCGACGGATACGCGACCAGCAAATGGGCCGGCGAG
GTCCTCCTGCGTGAGGCGCACGAGCGCTATGGCCTCCCCGTCGCCGTCTTCCGGTCCGAC
ATGGTCCTGGCGCACCGCACCTACACCGGACAGGTCAACGTCCCCGACGTCCTCACCCGG
CTGCTGCTCAGCCTGGTCGCCACCGGCATCGCCCCCGGCTCGTTCTACCGCACGGACACC
CGTGCCCACTACGACGGCCTGCCGGTCGACTTCACCGCGGAGGCCGTCGTCGCGCTGGGC
GCACCGATCACCGAGGGCCACCGGACCTTCAACGTCCTCAACCCGCACGACGACGGCGTT
TCCCTGGACACCTTCGTCGACTGGCTCATCGAGGCCGGCCACCCGATCCGGCGGATCGAC
GACCACGGTGCCTGGCTCACCCGCTTCACCGCGGCGCTCCGCGCCCTGCCGGAGAAGCAG
CGGCAGCACTCCCTGCTCCCGCTGATCGGCGCCTGGGCGGAACCCGGCGAAGGAGCCCCC
GGGCCGCTGCTCCCCGCCCGGCGCTTCCACGCCGCCGTCCGGGCGGCGGGGGTCGGCCCC
GAGCGGGACATTCCCCGGGTGTCGCCGGACCTCATCCGCAAGTACGTCACCGACCTGCGC
GCACTCGGGCTCCTCGCCGGCCCCTGA

Amino acid sequence (SEQ ID NO:68)

>uniprot|B1VMZ4|B1VMZ4_STRGG Putative carboxylic acid reductase

MAEPLDAATASAHDPGQGLAEALAAVEPGRALAEVMASVLEGHGDRPALG
ERAREPETGRLLPHFDTISYRELWSRVRALAGRWHHDPEYPLGPGDRICT
LGFTSTDYATLDLACIHLGAVPVPLPSNAPLPRLAPVVEESGPTVLAASV
DRLDTAIDVVLASSTIRRLLVFDDGPGATRPGGALAAARQRLSGSPVTVD
TLAGLIDRGRDLPPPPLYIPDPGEDPLALLIYTSGSTGAPKGAMYTQRLL
GTAWYGFSYGAADTPAISVLYLPQSHLAGRYAVMGSLVKGGTGYFTAADD
LSTLFEDIALVRPTELTMVPRLCDMLLQHYRSERDRRADEPGDIEAAVTK
AVREDFLGGRVAKAFVGTAPLSAELTAFVESVLGFHLYTGYGSTEAGGVL
LDTVVQRPPVTDYKLVDVPELGYYATDLPHPRGELLLKSHTLIPGYYRRP
DLTAAIFDADGYYRTGDVFAETGPDRLVYVDRTKDTLKLSQGEFVAVSRL
ETVLLDSPLVQHLYLYGNSERAYLLAVVVPTPDALAGCGGDTEALRPLLM
ESLRSVARRAGLNAYEIPRGILVEPEPFSPENGLFTESHKLLRPRLKERY
GPALELLYDRLADGQDRRLRELRRTGADRPVQETVLRAAQALLGSPGSDL
RPGAHFTDLGGDSLSAVSFSELMKEIFHVDVPVGAIIGPAADLAEVARYI
TAARRPAGAPRPTPASVHGEHRTEVRAGDLAPEKFLDAPTLAAAPALPRP
DGDVRTVLLTGATGYLGRFLCLEWLERLAPSGGRLVCLVRGSDATVAARR
LEAAFDSGDTALLRRYRKAAGKTLDVVAGDIGEPLLGLAEETWRELAGAV
DLIVHPAALVNHLLPYGELFGPNVVGTAEAIRLALTTRLKPVNHVSTVAV
CLGTPAETADENADIRAAVPVRTTGQGYADGYATSKWAGEVLLREAHERY
GLPVAVFRSDMVLAHRTYTGQVNVPDVLTRLLLSLVATGIAPGSFYRTDT
RAHYDGLPVDFTAEAVVALGAPITEGHRTFNVLNPHDDGVSLDTFVDWLI
EAGHPIRRIDDHGAWLTRFTAALRALPEKQRQHSLLPLIGAWAEPGEGAP
GPLLPARRFHAAVRAAGVGPERDIPRVSPDLIRKYVTDLRALGLLAGP

Nucleotide sequence (SEQ ID NO:69)

>uniprot|B2HE95|B2HE95_MYCMM Fatty-acid-CoA ligase FadD9_1

TTGTCAATTACCTGTGTGGATACCCGTGCACAGCGGAGCGCCCGTCGCATCGAGCAGCTT
TACTCCACCGATGCGCAATTCGCCGCCGCCCGGCCCAGTACGGCGGTCGGTATCGCAATC
AGCAAGTCCGGGTTGGGATTACCACAGATCATTCAAACGGTGATGGACGGATACCCGCAA
CGTCCGGCACTTGGGCAGCGGGCGACGCGCGTTGTTACCGATCCGAATACCGGGCGTAGC
TCGGCGCAGCTGTTGGCGGAGTTCGAGACCATCACCTACCGGGAGTTGTGGAACCGCACC
AATGCATTGACCAACGCATTCGCCGCCGAGGCACTTGCGGATCGCGGTCAGCGGGTCTGT
GTGCTGGGATTCGCGAGCATCGACTACGCCACCATCGACTTGGCGCTGATGTTGCTCGGC
GCGGTATCGGTTCCGTTGCCGACGAATGCGGCTCGCGCCCAGCTGTGCCATATCGTCTCC
GAGACCCAGCCCAGCCTGATCGCCTCGAGTACCGAAAACCTGCCCGATGCAATCTCTTTG
GTGCTGTCGCACCGCGCACCACACCGGGTGGTGGTGTTCGACTACCGCCCCGAACTCGAC
GCACACCGCGAAGCCCTCGAAGCCGCTCGCGCGCGCCTGGCCGCCATCCCGGTGACCGTC
GAAACGCTCACCGCCATCATCGCGCGCGGTCGAACGGTGCGGCCGGCCGAGGCCGATTGC
GGCGCCCAGTCCGCTGATGCACCGGCGCTTTTGATCTATACCTCCGGAAGCACCGGGGCA
CCCAAGGGCGTCGTCTACACCCGCAACCGGGTGGCGGACTTCTGGCGCACCTCGAAAGCC
GAGGTCGAAGCGACCGAACAACGAACCGCTCCTTCGATCACCCTCAACTTCATGCCGATG
AGCCACGCGAACGGCCGCCAGGTGCTCTACGGGACGCTGTCCAACGGCGGCACCGCGTAT
TTCACGGCCCGCAGCGACCTCTCGACGCTCTTCGATGATCTCGCGTTGGTCCGGCCCACC
GAATTGGGCTTTCCACCGCGCATTTGGGACATGCTGTTGGAGAGGTTTGGGCGCGAAGTC
GACCGTCGGCTCCGGGACGGCACAGCCGAGGGCGCCGACCCGGGCGCGCTGAAGGCTCGC
GTGGCGGCCGACCTACGCCAGGTGCTGCTCGGCGGACGGTATGCGCTGGCGATGATGGGC
TCCGCGCCAATCTCCGAGCAGATGAAAGCATCCGTCGAATCCCTGCTCGATCTGGACGTC
ATGGAGGGCTATGGCTCCACGGAAGCCGGAACGGTCATCATCAACAACGAGGTTCAGCGT
CCCCAGGTGATCGACTACAAGCTGGTCGACGTTGCGGAACTGGGCTATTTCCTTACCGAC
CGGCCATATCCGCGGGGCGAACTGCTGGTCAAAACGCGGACACTGTTTTCCGGCTACTAC
CGGGACCCCGAAGACGGCGCCCAGGTCTTCGACCCGGACGGCTTCTACCGGACCGGCGAC
ATCATGGCCCAAGTCGGCCCCGATCGGCTCGCCTACCTCGACCGGCGCAACAACGTGCTG
AAGCTGTCGCAGGGGGAGTTCGTCGCGGTCTCGCGACTAGAAGCAATATTTGCCAATAGC
CCGTTGGTCCGGCAGATCTTCGTCTATGCCAACGGTGCTCGCGCCTACCCACTGGCGGTA
GTCGTGCCCACCCAGGACGCACAGTCGCGCCACGGTCGCGCCGAACTCAAGGCCGAACTC
CATACATCGCTGCACCGCGTTGCCATGTCGGCCGGTCTGGCACCCTACGAGATCCCACGC
GACTTCATTGTCGAGACAACCCCCTTCACGCCGCAGAACGGCCTGCTCACCGCAATCCAC
AAGCTGGCCCGGCCGCACCTCACGCAGCGCTATGGCGCACGTCTGGAGCTGCTGTACACC
GAGCTGGCCGACAGCCAGACCCGCCGGCTGCACCGATTGCGCCAAACCGGTGGGCGGCTG
CCGGCGCTCGAGACCATCAGGCGTGCCGCCGGGGCACTGTTGGGCACGGAGACCACCGAG
CCGCGGCCCGAGGCCCACTTCAAAGATCTGGGCGGGGATTCGGTATCGGCGGTGACGTTC
TCCAACCTGCTACACGACATCTACGGTTTCGATGTTCCGGTCGGTGTGATCCTCGGCCCG
GCAACCGATTTGCGGGCGCTGGCCAGCCACGTCGAGAGCCGGCGCGGTGCCGGATGGTCG
GGGCCCAGCTTCGCGTCGGTGCACGTGCCCCGGGCGACCTCGGTACACGCCGGCGACCTG
AAACTGGCCAAGTTCCTGGACACCAAGACACTCGCAGCTGCCACGAGCCTGCCCGCTGCC
GATGCCCGGGCACGGACGGTGCTACTCACCGGCGCAACCGGATTCCTGGGACGCTACCTG
GTGCTGGAATGGCTGCGCCGGTTGCGGGCCGTCGGCGGCAAGCTGATCTGTCTGGTGCGC
GCCGCGTCCGACGAACAAGCCCGGGTTCGGCTGGATACGGCCTTCGATAGCGGCGATCCG
CAGCTGCCCGAGCACTTTCGGCAGCTCGCTGTCGACCGCCTGGAGGTCCTCGCCGGCGAT
AAGAGCGAACCAGGTCTCGGTCTGGACGGCCCAACCTGGCAGCGACTGGCCGACACGGTC
GACCTGATCGTCGACCCCGCCACGCTGGTCAACCACGTGCTGTCGTACCGGCAGCTGTTC
GCTCCCAACGTGGCGGGCACCGCCGAGTTGCTCCGCCTCGCACTCACCACCAAACGCAAG
CCCTATGCCTACGTCTCGACCGTCAGCGTGGCCAACCAGATCGAACCGTCCGCATTCACC

FIG. 4 (Cont.)

GAAGACGCCGACATCCGGGAGATCAGCCGCACCCGAACCATCGATGACAGCTTTGCCAAC
GGCTACACCACCAGCAAGTGGGCCAGCGAGGTGCTGTTGCGTGAGGCTCACGATCTGTGC
GGACTGCCGGTCACGGTCTTTCGTTGCGACATGATCCTGGCGGACACCAGCTACGCCGGC
CAGCTCAACCTCGCCGATACCTTCACCCGGCTGATGCTCAGTGTGGCGGCCACCGGGATC
GCGCCCGCCTCGTTCTACCGGCTGGGCCCCGACGGCAAACGCCAGCCCGCCCACTTCGAC
GGATTGCCCGTCGAATTCATCGCCGAGGCGGTGGCCACCCTGGGGGCGCGGCGCCACGAC
GGGTTCCAGGTCCACCATGTGGCGAATCCGCACCACGACGGCGTTGGGTTGGACGAGTAC
GTCGACTGGCTAGTCGATGCCGGTTGCCCCATCCGGCGCATTCCCGACTATGACGAGTGG
CTGAGTCGATTCGAGACGGCGCTGCACGCGCTGCCGGATCGCAAGCGTCGTCATTCACTG
CTTCCGCTGCTGCAGAACTATCGAGAACCCGCCGAGCCGATCCGGGGCGGCATCGCGCCC
GCACCACGGTTTCGCGGTGCGGTACGGCAGGCGAAAATCGGCCGCGACAACGACATTCCC
CATGTCGGCCCGGCGATCATCGCCAAGTACGCCAGCGACCTGCAGCTTCTCGGCCTGGCT
TGA

Amino acid sequence (SEQ ID NO:70)

>uniprot|B2HE95|B2HE95_MYCMM Fatty-acid-CoA ligase FadD9_1

MSITCVDTRAQRSARRIEQLYSTDAQFAAARPSTAVGIAISKSGLGLPQI
IQTVMDGYPQRPALGQRATRVVTDPNTGRSSAQLLAEFETITYRELWNRT
NALTNAFAAEALADRGQRVCVLGFASIDYATIDLALMLLGAVSVPLPTNA
ARAQLCHIVSETQPSLIASSTENLPDAISLVLSHRAPHRVVVFDYRPELD
AHREALEAARARLAAIPVTVETLTAIIARGRTVRPAEADCGAQSADAPAL
LIYTSGSTGAPKGVVYTRNRVADFWRTSKAEVEATEQRTAPSITLNFMPM
SHANGRQVLYGTLSNGGTAYFTARSDLSTLFDDLALVRPTELGFPPRIWD
MLLERFGREVDRRLRDGTAEGADPGALKARVAADLRQVLLGGRYALAMMG
SAPISEQMKASVESLLDLDVMEGYGSTEAGTVIINNEVQRPQVIDYKLVD
VAELGYFLTDRPYPRGELLVKTRTLFSGYYRDPEDGAQVFDPDGFYRTGD
IMAQVGPDRLAYLDRRNNVLKLSQGEFVAVSRLEAIFANSPLVRQIFVYA
NGARAYPLAVVVPTQDAQSRHGRAELKAELHTSLHRVAMSAGLAPYEIPR
DFIVETTPFTPQNGLLTAIHKLARPHLTQRYGARLELLYTELADSQTRRL
HRLRQTGGRLPALETIRRAAGALLGTETTEPRPEAHFKDLGGDSVSAVTF
SNLLHDIYGFDVPVGVILGPATDLRALASHVESRRGAGWSGPSFASVHVP
RATSVHAGDLKLAKFLDTKTLAAATSLPAADARARTVLLTGATGFLGRYL
VLEWLRRLRAVGGKLICLVRAASDEQARVRLDTAFDSGDPQLPEHFRQLA
VDRLEVLAGDKSEPGLGLDGPTWQRLADTVDLIVDPATLVNHVLSYRQLF
APNVAGTAELLRLALTTKRKPYAYVSTVSVANQIEPSAFTEDADIREISR
TRTIDDSFANGYTTSKWASEVLLREAHDLCGLPVTVFRCDMILADTSYAG
QLNLADTFTRLMLSVAATGIAPASFYRLGPDGKRQPAHFDGLPVEFIAEA
VATLGARRHDGFQVHHVANPHHDGVGLDEYVDWLVDAGCPIRRIPDYDEW
LSRFETALHALPDRKRRHSLLPLLQNYREPAEPIRGGIAPAPRFRGAVRQ
AKIGRDNDIPHVGPAIIAKYASDLQLLGLA

YP 001850422.1

Nucleotide sequence (SEQ ID NO:71)

>uniprot|B2HN69|B2HN69_MYCMM Fatty-acid-CoA ligase FadD9

ATGTCGCCAATCACGCGTGAAGAGCGGCTCGAGCGCCGCATCCAGGACCTCTACGCCAAC
GACCCGCAGTTCGCCGCCGCCAAACCCGCCACGGCGATCACCGCAGCAATCGAGCGGCCG
GGTCTACCGCTACCCCAGATCATCGAGACCGTCATGACCGGATACGCCGATCGGCCGGCT

FIG. 4 (Cont.)

CTCGCTCAGCGCTCGGTCGAATTCGTGACCGACGCCGGCACCGGCCACACCACGCTGCGA
CTGCTCCCCCACTTCGAAACCATCAGCTACGGCGAGCTTTGGGACCGCATCAGCGCACTG
GCCGACGTGCTCAGCACCGAACAGACGGTGAAACCGGGCGACCGGGTCTGCTTGTTGGGC
TTCAACAGCGTCGACTACGCCACGATCGACATGACTTTGGCGCGGCTGGGCGCGGTGGCC
GTACCACTGCAGACCAGCGCGGCGATAACCCAGCTGCAGCCGATCGTCGCCGAGACCCAG
CCCACCATGATCGCGGCCAGCGTCGACGCACTCGCTGACGCCACCGAATTGGCTCTGTCC
GGTCAGACCGCTACCCGAGTCCTGGTGTTCGACCACCACCGGCAGGTTGACGCACACCGC
GCAGCGGTCGAATCCGCCCGGGAGCGCCTGGCCGGCTCGGCGGTCGTCGAAACCCTGGCC
GAGGCCATCGCGCGCGGCGACGTGCCCCGCGGTGCGTCCGCCGGCTCGGCGCCCGGCACC
GATGTGTCCGACGACTCGCTCGCGCTACTGATCTACACCTCGGGCAGCACGGGTGCGCCC
AAGGGCGCGATGTACCCCCGACGCAACGTTGCGACCTTCTGGCGCAAGCGCACCTGGTTC
GAAGGCGGCTACGAGCCGTCGATCACGCTGAACTTCATGCCAATGAGCCACGTCATGGGC
CGCCAAATCCTGTACGGCACGCTGTGCAATGGCGGCACCGCCTACTTCGTGGCGAAAAGC
GATCTCTCCACCTTGTTCGAAGACCTGGCGCTGGTGCGGCCCACCGAGCTGACCTTCGTG
CCGCGCGTGTGGGACATGGTGTTCGACGAGTTTCAGAGTGAGGTCGACCGCCGCCTGGTC
GACGGCGCCGACCGGGTCGCGCTCGAAGCCCAGGTCAAGGCCGAGATACGCAACGACGTG
CTCGGTGGACGGTATACCAGCGCACTGACCGGCTCCGCCCCTATCTCCGACGAGATGAAG
GCGTGGGTCGAGGAGCTGCTCGACATGCATCTGGTCGAGGGCTACGGCTCCACCGAGGCC
GGGATGATCCTGATCGACGGAGCCATTCGGCGCCCGGCGGTACTCGACTACAAGCTGGTC
GATGTTCCCGACCTGGGTTACTTCCTGACCGACCGGCCACATCCGCGGGGCGAGTTGCTG
GTCAAGACCGATAGTTTGTTCCCGGGCTACTACCAGCGAGCCGAAGTCACCGCCGACGTG
TTCGATGCTGACGGCTTCTACCGGACCGGCGACATCATGGCCGAGGTCGGCCCCGAACAG
TTCGTGTACCTCGACCGCCGCAACAACGTGTTGAAGCTGTCGCAGGGCGAGTTCGTCACC
GTCTCCAAACTCGAAGCGGTGTTTGGCGACAGCCCACTGGTACGGCAGATCTACATCTAC
GGCAACAGCGCCCGTGCCTACCTGTTGGCGGTGATCGTCCCCACCCAGGAGGCGCTGGAC
GCCGTGCCTGTCGAGGAGCTCAAGGCGCGGCTGGGCGACTCGCTGCAAGAGGTCGCAAAG
GCCGCCGGCCTGCAGTCCTACGAGATCCCGCGCGACTTCATCATCGAAACAACACCATGG
ACGCTGGAGAACGGCCTGCTCACCGGCATCCGCAAGTTGGCCAGGCCGCAGCTGAAAAAG
CATTACGGCGAGCTTCTCGAGCAGATCTACACGGACCTGGCACACGGCCAGGCCGACGAA
CTGCGCTCGCTGCGCCAAAGCGGTGCCGATGCGCCGGTGCTGGTGACGGTGTGCCGTGCG
GCGGCCGCGCTGTTGGGCGGCAGCGCCTCTGACGTCCAGCCCGATGCGCACTTCACCGAT
TTGGGCGGCGACTCGCTGTCGGCGCTGTCGTTCACCAACCTGCTGCACGAGATCTTCGAC
ATCGAAGTGCCGGTGGGCGTCATCGTCAGCCCCGCCAACGACTTGCAGGCCCTGGCCGAC
TACGTCGAGGCGGCTCGCAAACCCGGCTCGTCACGGCCGACCTTCGCCTCGGTCCACGGC
GCCTCGAATGGGCAGGTCACCGAGGTGCATGCCGGTGACCTGTCCCTGGACAAATTCATC
GATGCCGCAACCCTGGCCGAAGCTCCCCGGCTGCCCGCCGCAAACACCCAAGTGCGCACC
GTGCTGCTGACCGGCGCCACCGGCTTCCTCGGGCGCTACCTGGCCCTGGAATGGCTGGAG
CGGATGGACCTGGTCGACGGCAAACTGATCTGCCTGGTCCGGGCCAAGTCCGACACCGAA
GCACGGGCGCGGCTGGACAAGACGTTCGACAGCGGCGACCCCGAACTGCTGGCCCACTAC
CGCGCACTGGCCGGCGACCACCTCGAGGTGCTCGCCGGTGACAAGGGCGAAGCCGACCTC
GGACTGGACCGGCAGACCTGGCAACGCCTGGCCGACACGGTCGACCTGATCGTCGACCCC
GCGGCCCTGGTCAACCACGTACTGCCATACAGCCAGCTGTTCGGGCCCAACGCGCTGGGC
ACCGCCGAGCTGCTGCGGCTGGCGCTCACCTCCAAGATCAAGCCCTACAGCTACACCTCG
ACAATCGGTGTCGCCGACCAGATCCCGCCGTCGGCGTTCACCGAGGACGCCGACATCCGG
GTCATCAGCGCCACCCGCGCGGTCGACGACAGCTACGCCAATGGCTACTCGAACAGCAAG
TGGGCCGGCGAGGTGCTGTTGCGCGAGGCGCATGACCTGTGTGGCCTGCCGGTTGCGGTG
TTCCGCTGCGACATGATCCTGGCCGACACCACATGGGCGGGACAGCTCAATGTGCCGGAC
ATGTTCACCCGGATGATCCTGAGCCTGGCGGCCACCGGTATCGCGCCGGGTTCGTTCTAT
GAGCTTGCGGCCGACGGCGCCCGGCAACGCGCCCACTATGACGGTCTGCCCGTCGAGTTC
ATCGCCGAGGCGATTTCGACTTTGGGTGCGCAGAGCCAGGATGGTTTCCACACGTATCAC
GTGATGAACCCCTACGACGACGGCATCGGACTCGACGAGTTCGTCGACTGGCTCAACGAG
TCCGGTTGCCCCATCCAGCGCATCGCTGACTATGGCGACTGGCTGCAGCGCTTCGAAACC
GCACTGCGCGCACTGCCCGATCGGCAGCGGCACAGCTCACTGCTGCCGCTGTTGCACAAC
TATCGGCAGCCGGAGCGGCCCGTCCGCGGGTCGATCGCCCCTACCGATCGCTTCCGGGCA

FIG. 4 (Cont.)

GCGGTGCAAGAGGCCAAGATCGGCCCCGACAAAGACATTCCGCACGTCGGCGCGCCGATC
ATCGTGAAGTACGTCAGCGACCTGCGCCTACTCGGCCTGCTCTGA

Amino acid sequence (SEQ ID NO:72)

>uniprot|B2HN69|B2HN69_MYCMM Fatty-acid-CoA ligase FadD9

MSPITREERLERRIQDLYANDPQFAAAKPATAITAAIERPGLPLPQIIET
VMTGYADRPALAQRSVEFVTDAGTGHTTLRLLPHFETISYGELWDRISAL
ADVLSTEQTVKPGDRVCLLGFNSVDYATIDMTLARLGAVAVPLQTSAAIT
QLQPIVAETQPTMIAASVDALADATELALSGQTATRVLVFDHHRQVDAHR
AAVESARERLAGSAVVETLAEAIARGDVPRGASAGSAPGTDVSDDSLALL
IYTSGSTGAPKGAMYPRRNVATFWRKRTWFEGGYEPSITLNFMPMSHVMG
RQILYGTLCNGGTAYFVAKSDLSTLFEDLALVRPTELTFVPRVWDMVFDE
FQSEVDRRLVDGADRVALEAQVKAEIRNDVLGGRYTSALTGSAPISDEMK
AWVEELLDMHLVEGYGSTEAGMILIDGAIRRPAVLDYKLVDVPDLGYFLT
DRPHPRGELLVKTDSLFPGYYQRAEVTADVFDADGFYRTGDIMAEVGPEQ
FVYLDRRNNVLKLSQGEFVTVSKLEAVFGDSPLVRQIYIYGNSARAYLLA
VIVPTQEALDAVPVEELKARLGDSLQEVAKAAGLQSYEIPRDFIIETTPW
TLENGLLTGIRKLARPQLKKHYGELLEQIYTDLAHGQADELRSLRQSGAD
APVLVTVCRAAAALLGGSASDVQPDAHFTDLGGDSLSALSFTNLLHEIFD
IEVPVGVIVSPANDLQALADYVEAARKPGSSRPTFASVHGASNGQVTEVH
AGDLSLDKFIDAATLAEAPRLPAANTQVRTVLLTGATGFLGRYLALEWLE
RMDLVDGKLICLVRAKSDTEARARLDKTFDSGDPELLAHYRALAGDHLEV
LAGDKGEADLGLDRQTWQRLADTVDLIVDPAALVNHVLPYSQLFGPNALG
TAELLRLALTSKIKPYSYTSTIGVADQIPPSAFTEDADIRVISATRAVDD
SYANGYSNSKWAGEVLLREAHDLCGLPVAVFRCDMILADTTWAGQLNVPD
MFTRMILSLAATGIAPGSFYELAADGARQRAHYDGLPVEFIAEAISTLGA
QSQDGFHTYHVMNPYDDGIGLDEFVDWLNESGCPIQRIADYGDWLQRFET
ALRALPDRQRHSSLLPLLHNYRQPERPVRGSIAPTDRFRAAVQEAKIGPD
KDIPHVGAPIIVKYVSDLRLLGLL

O69484

Nucleotide sequence (SEQ ID NO:73)

>uniprot|O69484|O69484_MYCLE Putative Acyl-CoA synthetase

ATGTCGACTATCACTAAGCAGGAAAAGCAGCTCGCACGCCGCGTTGACGACCTCACCGCC
AACGACCCGCAGTTCGCCGCCGCCAAACCCGACCCGGCGGTAGCCGCCGCCCTTGCCCAG
CCCGGGCTTCGACTGCCCCAAATCATCCAGACCGCGCTGGACGGTTACGCGGAGCGGCCG
GCACTGGGCCAGCGCGTCGCCGAGTTCACCAAAGACCCTAAGACCGGACGCACCTCGATG
GAGCTGCTCCCCAGCTTTGAGACCATCACCTACCGCCAGTTGGGCGACCGTGTCGGAGCG
CTGGCGCGCGCCTGGAGGCACGACCTACTGCACGCCGGCTACCGGGTCTGCGTGCTAGGT
TTCAACAGTGTCGATTACGCCATCATCGACATGGCGCTCGGCGTGATTGGTGCTGTGGCG
GTTCCACTGCAGACCAGTGCGGCGATCACCCAGCTGCAGTCGATCGTGACCGAGACCGAA
CCCAGTATGATCGCGACGAGCGTAAACCAGCTGCCCGATACTGTCGAGCTGATCCTGTCT
GGCCAGGCGCCAGCGAAGCTCGTTGTGTTTGACTACCACCCCGAGGTCGACGAGCAGCAT
GACGCAGTGGCAACCGCCCGGGCGCGGTTGGCGGACAGTAGCGTGGTGGTCGAGAGCCTG
ACCGAGGTCCTCGGTCGCGGCAAGACGCTGCCAGCTACGCCGATCCCCGTGGCCGATGAC
TCTGCTGACCCGTTGGCGTTGCTGATCTACACATCTGGCAGCACCGGCGCACCCAAGGGC
GCGATGTATCTGCAAAGCAATGTCGGCAAGATGTGGCGCCGGTCAGACGGAAACTGGTTC

FIG. 4 (Cont.)

GGGCCAACCGCCGCGTCAATCACTCTTAACTTCATGCCGATGAGCCACGTCATGGGCCGC
GGAATCCTCTACGGCACGCTCGGTAACGGCGGCACGGCTTACTTCGCCGCCCGCAGCGAC
CTCTCGACGCTGCTGGAGGATCTCAAGCTGGTGCGGCCGACCGAGTTGAACTTTGTACCG
CGCATCTGGGAAACCCTCTACGATGAATCCAAACGCGCAGTTGACCGTCGGTTAGCCAAC
AGCGGCTCCGCCGACCGTGCAGCCATCAAAGCCGAAGTTATGGATGAACAGCGGCAATCC
CTGCTGGGAGGACGGTACATCGCGGCTATGACGGGCTCGGCGCCAACCTCCCCGGAGTTG
AAACACGGGGTCGAGTCCCTACTCGAAATGCATCTGTTGGAAGGCTACGGCTCCACCGAA
GCCGGCATGGTCTTGTTTGACGGCGAAGTGCAACGTCCGCCGGTTATCGATTACAAGCTG
GTCGACGTTCCGGATTTGGGCTACTTCAGCACCGACCAGCCTTATCCGAGAGGTGAATTG
CTGCTCAAGACCCAGAACATGTTCCCCGGCTACTACAAGCGTCCTGAGGTTACCGCCACC
GTGTTCGACAGCGACGGTTACTACCAGACCGGAGACATTGTCGCCGAAGTCGGTCCCGAC
CGGCTCGTGTACGTCGATCGCCGCAACAACGTGCTGAAACTCGCGCAGGGCCAGTTCGTC
ACCGTCGCGAAACTCGAGGCAGCGTTCAGCAATAGCCCACTGGTCCGGCAGATCTACATC
TATGGCAACAGCGCACACCCCTACCTGTTGGCTGTTGTGGTGCCGACCGAGGATGCGTTG
GCTACCAATGACATTGAGGTGCTCAAACCGCTGATTATCGATTCTTTACAGAAAGTAGCG
AAAGAAGCCGACCTGCAGTCCTACGAGGTGCCGCGCGACTTAATCGTCGAGACTACACCG
TTCAGCCTGGAGAATGGCCTGCTCACCGGTATTCGCAAGCTGGCGTGGCCGAAGCTCAAG
CAGCACTACGGCGCGCGACTCGAACAGCTCTACGCCGATCTGGTTGAAGGTCAGGCAAAT
GCACTGCACGTGCTAAAACAAAGCGTGGCGAACGCTCCGGTACTGCAGACGGTGAGCCGA
GCCGTGGGCACCATTCTGGGAGTGGCGACCACCGATTTGCCGTCGAATGCGCACTTCACC
GACTTAGGAGGAGACTCGTTGTCCGCGCTGACATTCGGTAGCCTGCTACGCGAACTCTTC
GACATCGATGTGCCGGTGGGCGTCATTGTCAGCCCTGTCAACAACTTGGTGGCGATCGCC
GACTACATCGAGCGCGAGCGGCAGGGCACGAAGCGGCCCACTTTCATTGCCATACACGGT
CGTGACGCTGGCAAAGTGCATGCCAGTGACCTCACTCTAGACAAATTCATCGATGTATCA
ACGCTGACTGCCGCGCCCGTATTGGCGCAACCCGGCACCGAGGTGCGCACCGTCCTGTTG
ACCGGCGCTACCGGCTTCCTGGGGCGCTACTTGGCCCTGAAATGGCTCGAACGGATGGAC
CTGGTCGAAGGGAAGGTAATCGCTCTGGTAAGAGCCAAGTCCAACGAGGACGCTCGGGCC
CGGCTCGACAAGACCTTCGATAGCGGAGACCCCAAACTGCTGGCGCACTACCAGGAACTG
GCAACCGACCACCTGGAGGTCATCGCCGGCGACAAAGGCGAAGTAGATCTGGAATTGGAC
CGGCAAACGTGGCGACGACTGGCCGACACGGTCGATCTGATCGTCGACCCCGCCGCCCTG
GTCAACCACGTGCTGCCGTACAGCGAGCTATTCGGCCCCAATACGTTAGGCACCGCCGAG
CTGATTCGGATCGCGCTGACCAGTAAGCAAAAGCCGTACATCTATGTGTCGACAATCGGC
GTCGGTAATCAGATTGAGCCAGCAAAATTCACCGAAGACTCCGACATCCGAGTCATTAGC
CCGACGCGCAACATCAACAACAACTATGCCAACGGCTACGGCAACAGCAAGTGGGCCGGC
GAAGTGCTGCTGCGCGAAGCTCACGACCTATGCGGTCTGCCGGTCACGGTCTTCCGCTGC
GACATGATCTTGGCCGACACCAGCTATGCCGGTCAGCTCAACGTCCCCGACATGTTTACT
CGAATGATGCTGAGTCTAGCCGCCACCGGCATCGCACCCGGCTCGTTCTACGAGCTAGAC
GCCGAGAGCAATCGGCAACGCGCCCACTACGACGGTCTGCCCGTCGAGTTCATCGCCGAA
GCGATCTCCACCCTGGGAGACCAAAGCCTGCACGATCGAGACGGGTTCACGACCTATCAT
GTAATGAACCCGCACGACGACGGCATCGGTATGGACGAGTTTGTGGACTGGTTAATTGAT
GCCGGCTGCCCTATACAACGCATCAACGACTACGACGAATGGCTGCGACGGTTTGAGATT
TCGCTGCGCGCCCTGCCCGAAAGGCAGCGTCACAGCTCACTGTTGCCGTTGTTGCACAAC
TACCAGAAGCCGGAGAAGCCATTGCACGGGTCGCTGGCACCCACAATCCGGTTCCGTACG
GCCGTTCAAAACGCGAACATTGGTCAGGACAAAGATATTCCGCATATCTCGCCGGCAATC
ATCGCCAAATATGTCAGCGATCTGCAGCTGCTCGGGCTGGTTTGA

Amino acid sequence (SEQ ID NO:74)

>uniprot|O69484|O69484_MYCLE Putative Acyl-CoA synthetase

MSTITKQEKQLARRVDDLTANDPQFAAAKPDPAVAAALAQPGLRLPQIIQ
TALDGYAERPALGQRVAEFTKDPKTGRTSMELLPSFETITYRQLGDRVGA
LARAWRHDLLHAGYRVCVLGFNSVDYAIIDMALGVIGAVAVPLQTSAAIT

FIG. 4 (Cont.)

QLQSIVTETEPSMIATSVNQLPDTVELILSGQAPAKLVVFDYHPEVDEQH
DAVATARARLADSSVVVESLTEVLGRGKTLPATPIPVADDSADPLALLIY
TSGSTGAPKGAMYLQSNVGKMWRRSDGNWFGPTAASITLNFMPMSHVMGR
GILYGTLGNGGTAYFAARSDLSTLLEDLKLVRPTELNFVPRIWETLYDES
KRAVDRRLANSGSADRAAIKAEVMDEQRQSLLGGRYIAAMTGSAPTSPEL
KHGVESLLEMHLLEGYGSTEAGMVLFDGEVQRPPVIDYKLVDVPDLGYFS
TDQPYPRGELLLKTQNMFPGYYKRPEVTATVFDSDGYYQTGDIVAEVGPD
RLVYVDRRNNVLKLAQGQFVTVAKLEAAFSNSPLVRQIYIYGNSAHPYLL
AVVVPTEDALATNDIEVLKPLIIDSLQKVAKEADLQSYEVPRDLIVETTP
FSLENGLLTGIRKLAWPKLKQHYGARLEQLYADLVEGQANALHVLKQSVA
NAPVLQTVSRAVGTILGVATTDLPSNAHFTDLGGDSLSALTFGSLLRELF
DIDVPVGVIVSPVNNLVAIADYIERERQGTKRPTFIAIHGRDAGKVHASD
LTLDKFIDVSTLTAAPVLAQPGTEVRTVLLTGATGFLGRYLALKWLERMD
LVEGKVIALVRAKSNEDARARLDKTFDSGDPKLLAHYQELATDHLEVIAG
DKGEVDLELDRQTWRRLADTVDLIVDPAALVNHVLPYSELFGPNTLGTAE
LIRIALTSKQKPYIYVSTIGVGNQIEPAKFTEDSDIRVISPTRNINNNYA
NGYGNSKWAGEVLLREAHDLCGLPVTVFRCDMILADTSYAGQLNVPDMFT
RMMLSLAATGIAPGSFYELDAESNRQRAHYDGLPVEFIAEAISTLGDQSL
HDRDGFTTYHVMNPHDDGIGMDEFVDWLIDAGCPIQRINDYDEWLRRFEI
SLRALPERQRHSSLLPLLHNYQKPEKPLHGSLAPTIRFRTAVQNANIGQD
KDIPHISPAIIAKYVSDLQLLGLV

Q10896

Nucleotide sequence (SEQ ID NO:75)

>uniprot|Q10896|Q10896_MYCTU PROBABLE PEPTIDE SYNTHETASE NRP (PEPTIDE SYNTHASE)

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACG
CTTTCCAACGGCGGTACCGCCTACTTCGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCCGGGGCGAGCTGCTGGTCAAGACGCAAACCATG
TTCCCCGGCTACTACCAGCGCCCGGATGTCACCGCCGAGGTGTTCGACCCCGACGGCTTC

FIG. 4 (Cont.)

TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCCTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCCGCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA

Amino acid sequence (SEQ ID NO:76)

>uniprot|Q10896|Q10896_MYCTU PROBABLE PEPTIDE SYNTHETASE NRP (PEPTIDE SYNTHASE)

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG

FIG. 4 (Cont.)

DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

Q5YY80

Nucleotide sequence (SEQ ID NO:77)

>uniprot|Q5YY80|Q5YY80_NOCFA Putative carboxylic acid reductase

GTGGAATCCACACGAGCGACGCGTCTGCGGCAGCGGATCGCCGCCCTGTACGCCGACGAC
GCGCAGGTGCGCGACGCGCGGCCGGACGAGGCGATCAGCACGGCGCTGCGGGAACCGGGC
CTGCGGCTGCGCGAGCTCGTCGCCACCGTGGTCGACGGCTACCGCGACCGGCCCGCGCTG
GCCGCGCGCTCGGTGCAGCCGGCCGTCGACGCCGCGACCGGTGCCTGCGTGGCACGGTTG
CTGCCCGAGTACACGACGATGAGTTACGGCGAGCTCGGCCTGCGGTTGCGCGCGGTGGCC
GCGGCCTGGCAGCACGACGACGAAACCCGCCTTCGCCCCGGCGAATTCGTCGCGACCCTG
GGTTTCACCAGCCCCGACTACGCCGTCGTCGACCTGGCCTGCGTGTGGGCGGGCGCGGTG
GCGGTGCCGCTGCAGGCGAGCGCGTCGGTGACGCAGCTGACCGCCATCCTGGCCGAGACC
GCGCCCGCAATCCTGGCCACCGGCCTGGACACGCTGCCGCACGCGGTGGACTGTGTGCTC
GCCGGGGCCACGCCACGGGCACTGCACGTGTTCGACTTCGACCCCGCCATCGACGCGCAG
CGCACGGTGTACGAGGCGGCGTGTGCGCGGCTGGCCGGTACCGGTGTGCGCGTGCGCACG
CTCGCCGAGGTCGAGGACCGCGGCCGGGCGCTGCCGCCTGCCGTGATCGACGACGGCCCC
GGCGACGACCGGCTCGCCCTGTTGATCTACACCTCCGGCAGTACCGGCACGCCCAAGGGG
GCGATGTACACCGAGCGGCTGGTCGCGCTGATGTGGCTGGGCCAGCCGCAGGTCGCCCGCG
CTCACCGTCAACTACCTGCCGCTCAGCCACGTCGCCGGGCGGCTGGCGCTGTTCGGGCTG
CTCGCGCGCGGCGGCACCGCCTACTTCACCGCGCGCGCCGACATGTCCACGCTGTTCGAG
GATCTGGCGCTGGCCAGGCCGACCGAGCTGTTCGTGGTGCCGCGCGTGTGCGAGATGGTG
CTGCAACGATTCCAGACCGAGCGGCTGCGGCGCCAGGCCGACGACGACCGGGTCAAGGCC
GACCTGCGCCTCGAACTGTTCGGCGACCGGCTGCTCTCGGTGGTGTGCGGCAGCGCGCCG
CTGGCCCCGGAGCTGAAGGCGTTCATGGAATCGGTGCTCGACCTGACCCTGCACGACGGC
TACGGCTCCACCGAGGCGGGCGGCAGCGTGGTCATCGACACCAGCGTGCGCAGGCCGCCG
GTGCTGGACTACCGGCTCGCCGACGTGCCCGAACTGGGCTATTTCCGTACCGACAAGCCG
CATCCGCGCGGCGAGCTGCTGCTCAAGACCACCACCATGATCCCCGGCTACTACCGGCGG
CCGGAGCTCAACGCCCAGATCTTCGACGAGGACGGCTTCTACCGCACCGGCGACGTGGTC
GCGGAACTGGCGCCGGACCGGCTCGTGTACGTCGATCGCCGCAACAATGTGCTCAAGCTG
GCGCAGGGCGAGTTCGTCACCATCGCCCGGCTGGAGGCGATCTTCGCCAACAGTCCGCTG
GTGCGCCAGATCTTCGTCTACGGCAACAGCGAACGCGCCTATCTGCTGGCGGTGATCGTG
CCGAGCCGACAGGCGATGGCGGGCGATCCGGCCACGCTGAAGACGCGGATCGCGGAGTCG
TTGCAGCTCATCGGCCGGGACGCCGAGCTGGAGGCCTACGAGATCCCGCGCGACTTCCTG
ATCGAGACCGAGCCGTTCACCACCGAATCCGGGCTGCTCTCGGGCATCGGCAAGATCCTG
CGTCCCGCCGTCGAGGCGCGCTATCGCGACCGGCTCGAACAGCTCTACGCCGACCTGGCC
GCGGCCCAGCAGGACGAGCTGGCGGCGCTGCGCCGCGAGGCCGGGCAGCGTCCGGTGCTC
GAGACCGTCACCCGCGCGGCCGCCGCGATCCTCGGCGGCACGGCGAGCGACCTGAGCCCG

FIG. 4 (Cont.)

GCCGCGCACTTCACCGATCTCGGCGGCGATTCGCTGGCGGCGCTGGCGCTGTCGAACCTG
CTGCGTGAGATCTTCGCCGTCGAGGTGCCGGTCGGCGTCATCACCGGCCCCGCGACCGAC
CTCCGTGGCCTGGCCGCCCACATCGCCGCGGAACGCGAAAACCGCACCGAGACACCGCTG
TTCGACCGGGTGCATCCCGACCAGATCCTGATCCGGGCCACCGACCTCGCCCTGGAGAAG
TTCTTCGACGCCGAGGAGTTGGCCGCCGCGGCCACCGCCGCGCCGCCGGTCGCCGAGCCC
CGGGTGGTGCTGCTGACCGGTGCCAACGGCTATCTCGGCCGGTTTCTGTGCCTGGAATGG
CTGGAACGGCTCGACCGCGTCGACGGACGGCTGATCTGCCTGGTGCGCGGCGCGGACGAG
GCCGCCGCGCTGGCCCGCCTGGAAGCCGCCTTCGACAGCGGCGATCCCGAATTGGTGCGC
CGCTTCAAGGAATTGGCCCAGCGCAGGCTCACCGTGGTGGCCGGCGACATCGGCGAGCCC
GGCCTGGGCCTGGCCACCGCCACGTGGCGACGGCTCGCCGCCGAGGTCGAGCACATCGTG
CACCCGGCCGCGCTGGTCAACCACGTGCTGCCCTACCGGCAGCTGTTCGGGCCCAACGTG
GCGGGCACCGCGGAGATCCTGCGGCTCGCGCTCACCGAGCGGCGCAAGCCGATCGACTTC
CTGTCCACGGTCGCCGTTGCCGCGCAGATACCCGCCGACCGGTTCGCCGAGGACGGCGAC
ATCCGCGTGATCAGCCCGACCCGCACGGTGGACCGCGGCTACGCCAACGGCTACGGCAAC
AGCAAATGGGCCGCCGAGGTGTTGCTGCGTGCGGCGCACGACCGCTTCGATCTCCCGGTG
GCGGTGTTCCGCTCGGACATGATCCTGGCCCACGGCAGCTTCGCCGGACAGCTCAACATC
CCCGACGTGTTCACCCGGCTGCTGCTCAGCCTGCTGGTCACCGGTATCGCGCCCGCCTCG
TTCCACGCCGCGACGGTCACCGGCGAGCGCCCGCGCGCCCACTACGACGGGCTGCCCGCG
GACTTCACCGCTGCCGCGATCACCGCGCTCGGGGCGCGCACCGCGGGATTCCACACCTAC
GACGTGCTCAACCCGCACGACGACGGCATCAGCCTGGACACCTTCGTGGACTGGCTGATC
GAGGCCGGACATCCCATCGAACGCATCCCCGAGCACAGCGAGTGGGTCACCCGTTTCGAG
ACGGCGTTGCACGCCCTGCCCGAACGTCAGCGCAAACACTCGCTGCTCCCGCTGTTGCAC
GCCTACCGCAGGCCGGTGCCCGCGCTGCGCGGCTCGGCGCTGCCCGCCGCGGAGTTCCGG
GCGGCGGTGCGGGCCGCAGGCATCACCGCCGACGGTGACATCCCGCACCTGACGCGCGCG
CTGATCGAGAAGTACGTCGCCGATCTCCGCCTGCACGGACTGTTGTAG

Amino acid sequence (SEQ ID NO:78)

>uniprot|Q5YY80|Q5YY80_NOCFA Putative carboxylic acid reductase

VESTRATRLRQRIAALYADDAQVRDARPDEAISTALREPGLRLRELVATV
VDGYRDRPALAARSVQPAVDAATGACVARLLPEYTTMSYGELGLRLRAVA
AAWQHDDETRLRPGEFVATLGFTSPDYAVVDLACVWAGAVAVPLQASASV
TQLTAILAETAPAILATGLDTLPHAVDCVLAGATPRALHVFDFDPAIDAQ
RTVYEAACARLAGTGVRVRTLAEVEDRGRALPPAVIDDGPGDDRLALLIY
TSGSTGTPKGAMYTERLVALMWLGQPQVAALTVNYLPLSHVAGRLALFGL
LARGGTAYFTARADMSTLFEDLALARPTELFVVPRVCEMVLQRFQTERLR
RQADDDRVKADLRLELFGDRLLSVVCGSAPLAPELKAFMESVLDLTLHDG
YGSTEAGGSVVIDTTVRRPPVLDYRLADVPELGYFRTDKPHPRGELLLKT
TTMIPGYYRRPELNAQIFDEDGFYRTGDVVAELAPDRLVYVDRRNNVLKL
AQGEFVTIARLEAIFANSPLVRQIFVYGNSERAYLLAVIVPSRQAMAGDP
ATLKTRIAESLQLIGRDAELEAYEIPRDFLIETEPFTTESGLLSGIGKIL
RPAVEARYRDRLEQLYADLAAAQQDELAALRREAGQRPVLETVTRAAAAI
LGGTASDLSPAAHFTDLGGDSLAALALSNLLREIFAVEVPVGVITGPATD
LRGLAAHIAAERENRTETPLFDRVHPDQILIRATDLALEKFFDAEELAAA
ATAAPPVAEPRVVLLTGANGYLGRFLCLEWLERLDRVDGRLICLVRGADE
AAALARLEAAFDSGDPELVRRFKELAQRRLTVVAGDIGEPGLGLATATWR
RLAAEVEHIVHPAALVNHVLPYRQLFGPNVAGTAEILRLALTERRKPIDF
LSTVAVAAQIPADRFAEDGDIRVISPTRTVDRGYANGYGNSKWAAEVLLR
AAHDRFDLPVAVFRSDMILAHGSFAGQLNIPDVFTRLLLSLLVTGIAPAS
FHAATVTGERPRAHYDGLPADFTAAAITALGARTAGFHTYDVLNPHDDGI
SLDTFVDWLIEAGHPIERIPEHSEWVTRFETALHALPERQRKHSLLPLLH

FIG. 4 (Cont.)

AYRRPVPALRGSALPAAEFRAAVRAAGITADGDIPHLTRALIEKYVADLR
LHGLL

Q6RKB1

Nucleotide sequence (SEQ ID NO:79)

>uniprot|Q6RKB1|Q6RKB1_9NOCA ATP/NADPH-dependent carboxylic acid reductase

ATGGCAGTGGATTCACCGGATGAGCGGCTACAGCGCCGCATTGCACAGTTGTTTGCAGAA
GATGAGCAGGTCAAGGCCGCACGTCCGCTCGAAGCGGTGAGCGCGGCGGTGAGCGCGCCC
GGTATGCGGCTGGCGCAGATCGCCGCCACTGTTATGGCGGGTTACGCCGACCGCCCGGCC
GCCGGGCAGCGTGCGTTCGAACTGAACACCGACGACGCGACGGGCCGCACCTCGCTGCGG
TTACTTCCCCGATTCGAGACCATCACCTATCGCGAACTGTGGCAGCGAGTCGGCGAGGTT
GCCGCGGCCTGGCATCATGATCCCGAGAACCCCTTGCGCGCAGGTGATTTCGTCGCCCTG
CTCGGCTTCACCAGCATCGACTACGCCACCCTCGACCTGGCCGATATCCACCTCGGCGCG
GTTACCGTGCCGTTGCAGGCCAGCGCGGCGGTGTCCCAGCTGATCGCTATCCTCACCGAG
ACTTCGCCGCGGCTGCTCGCCTCGACCCCGGAGCACCTCGATGCGGCGGTCGAGTGCCTA
CTCGCGGGCACCACACCGGAACGACTGGTGGTCTTCGACTACCACCCCGAGGACGACGAC
CAGCGTGCGGCCTTCGAATCCGCCCGCCGCCGCCTTGCCGACGCGGGCAGCTTGGTGATC
GTCGAAACGCTCGATGCCGTGCGTGCCCGGGGCCGCGACTTACCGGCCGCGCCACTGTTC
GTTCCCGACACCGACGACGACCCGCTGGCCCTGCTGATCTACACCTCCGGCAGCACCGGA
ACGCCGAAGGGCGCGATGTACACCAATCGGTTGGCCGCCACGATGTGGCAGGGGAACTCG
ATGCTGCAGGGGAACTCGCAACGGGTCGGGATCAATCTCAACTACATGCCGATGAGCCAC
ATCGCCGGTCGCATATCGCTGTTCGGCGTGCTCGCTCGCGGTGGCACCGCATACTTCGCG
GCCAAGAGCGACATGTCGACACTGTTCGAAGACATCGGCTTGGTACGTCCCACCGAGATC
TTCTTCGTCCCGCGCGTGTGCGACATGGTCTTCCAGCGCTATCAGAGCGAGCTGGACCGG
CGCTCGGTGGCGGGCGCCGACCTGGACACGCTCGATCGGGAAGTGAAAGCCGACCTCCGG
CAGAACTACCTCGGTGGGCGCTTCCTGGTGGCGGTCGTCGGCAGCGCGCCGCTGGCCGCG
GAGATGAAGACGTTCATGGAGTCCGTCCTCGATCTGCCACTGCACGACGGGTACGGGTCG
ACCGAGGCGGGCGCAAGCGTGCTGCTCGACAACCAGATCCAGCGGCCGCCGGTGCTCGAT
TACAAGCTCGTCGACGTGCCCGAACTGGGTTACTTCCGCACCGACCGGCCGCATCCGCGC
GGTGAGCTGTTGTTGAAGGCGGAGACCACGATTCCGGGCTACTACAAGCGGCCCGAGGTC
ACCGCGGAGATCTTCGACGAGGACGGCTTCTACAAGACCGGCGATATCGTGGCCGAGCTC
GAGCACGATCGGCTGGTCTATGTCGACCGTCGCAACAATGTGCTCAAACTGTCGCAGGGC
GAGTTCGTGACCGTCGCCCATCTCGAGGCCGTGTTCGCCAGCAGCCCGCTGATCCGGCAG
ATCTTCATCTACGGCAGCAGCGAACGTTCCTATCTGCTCGCGGTGATCGTCCCCACCGAC
GACGCGCTGCGCGGCCGCGACACCGCCACCTTGAAATCGGCACTGGCCGAATCGATTCAG
CGCATCGCCAAGGACGCGAACCTGCAGCCCTACGAGATTCCGCGCGATTTCCTGATCGAG
ACCGAGCCGTTCACCATCGCCAACGGACTGCTCTCCGGCATCGCGAAGCTGCTGCGCCCC
AATCTGAAGGAACGCTACGGCGCTCAGCTGGAGCAGATGTACACCGATCTCGCGACAGGC
CAGGCCGATGAGCTGCTCGCCCTGCGCCGCGAAGCCGCCGACCTGCCGGTGCTCGAAACC
GTCAGCCGGGCAGCGAAAGCGATGCTCGGCGTCGCCTCCGCCGATATGCGTCCCGACGCG
CACTTCACCGACCTGGGCGGCGATTCCCTTTCCGCGCTGTCGTTCTCGAACCTGCTGCAC
GAGATCTTCGGGGTCGAGGTGCCGGTGGGTGTCGTCGTCAGCCCGGCGAACGAGCTGCGC
GATCTGGCGAATTACATTGAGGCGGAACGCAACTCGGGCGCGAAGCGTCCCACCTTCACC
TCGGTGCACGGCGGCGGTTCCGAGATCCGCGCCGCCGATCTGACCCTCGACAAGTTCATC
GATGCCCGCACCCTGGCCGCCGCCGACAGCATTCCGCACGCGCCGGTGCCAGCGCAGACG
GTGCTGCTGACCGGCGCGAACGGCTACCTCGGCCGGTTCCTGTGCCTGGAATGGCTGGAG
CGGCTGGACAAGACGGGTGGCACGCTGATCTGCGTCGTGCGCGGTAGTGACGCGGCCGCG

FIG. 4 (Cont.)

GCCCGTAAACGGCTGGACTCGGCGTTCGACAGCGGCGATCCCGGCCTGCTCGAGCACTAC
CAGCAACTGGCCGCACGGACCCTGGAAGTCCTCGCCGGTGATATCGGCGACCCGAATCTC
GGTCTGGACGACGCGACTTGGCAGCGGTTGGCCGAAACCGTCGACCTGATCGTCCATCCC
GCCGCGTTGGTCAACCACGTCCTTCCCTACACCCAGCTGTTCGGCCCCAATGTCGTCGGC
ACCGCCGAAATCGTCCGGTTGGCGATCACGGCGCGGCGCAAGCCGGTCACCTACCTGTCG
ACCGTCGGAGTGGCCGACCAGGTCGACCCGGCGGAGTATCAGGAGGACAGCGACGTCCGC
GAGATGAGCGCGGTGCGCGTCGTGCGCGAGAGTTACGCCAACGGCTACGGCAACAGCAAG
TGGGCGGGGGAGGTCCTGCTGCGCGAAGCACACGATCTGTGTGGCTTGCCGGTCGCGGTG
TTCCGTTCGGACATGATCCTGGCGCACAGCCGGTACGCGGGTCAGCTCAACGTCCAGGAC
GTGTTCACCCGGCTGATCCTCAGCCTGGTCGCCACCGGCATCGCGCCGTACTCGTTCTAC
CGAACCGACGCGGACGGCAACCGGCAGCGGGCCCACTATGACGGCTTGCCGGCGGACTTC
ACGGCGGCGGCGATCACCGCGCTCGGCATCCAAGCCACCGAAGGCTTCCGGACCTACGAC
GTGCTCAATCCGTACGACGATGGCATCTCCCTCGATGAATTCGTCGACTGGCTCGTCGAA
TCCGGCCACCCGATCCAGCGCATCACCGACTACAGCGACTGGTTCCACCGTTTCGAGACG
GCGATCCGCGCGCTGCCGGAAAAGCAACGCCAGGCCTCGGTGCTGCCGTTGCTGGACGCC
TACCGCAACCCCTGCCCGGCGGTCCGCGGCGCGATACTCCCGGCCAAGGAGTTCCAAGCG
GCGGTGCAAACAGCCAAAATCGGTCCGGAACAGGACATCCCGCATTTGTCCGCGCCACTG
ATCGATAAGTACGTCAGCGATCTGGAACTGCTTCAGCTGCTCTGA

Amino acid sequence (SEQ ID NO:80)

>uniprot|Q6RKB1|Q6RKB1_9NOCA ATP/NADPH-dependent carboxylic acid reductase

MAVDSPDERLQRRIAQLFAEDEQVKAARPLEAVSAAVSAPGMRLAQIAAT
VMAGYADRPAAGQRAFELNTDDATGRTSLRLLPRFETITYRELWQRVGEV
AAAWHHDPENPLRAGDFVALLGFTSIDYATLDLADIHLGAVTVPLQASAA
VSQLIAILTETSPRLLASTPEHLDAAVECLLAGTTPERLVVFDYHPEDDD
QRAAFESARRRLADAGSLVIVETLDAVRARGRDLPAAPLFVPDTDDDPLA
LLIYTSGSTGTPKGAMYTNRLAATMWQGNSMLQGNSQRVGINLNYMPMSH
IAGRISLFGVLARGGTAYFAAKSDMSTLFEDIGLVRPTEIFFVPRVCDMV
FQRYQSELDRRSVAGADLDTLDREVKADLRQNYLGGRFLVAVVGSAPLAA
EMKTFMESVLDLPLHDGYGSTEAGASVLLDNQIQRPPVLDYKLVDVPELG
YFRTDRPHPRGELLLKAETTIPGYYKRPEVTAEIFDEDGFYKTGDIVAEL
EHDRLVYVDRRNNVLKLSQGEFVTVAHLEAVFASSPLIRQIFIYGSSERS
YLLAVIVPTDDALRGRDTATLKSALAESIQRIAKDANLQPYEIPRDFLIE
TEPFTIANGLLSGIAKLLRPNLKERYGAQLEQMYTDLATGQADELLALRR
EAADLPVLETVSRAAKAMLGVASADMRPDAHFTDLGGDSLSALSFSNLLH
EIFGVEVPVGVVVSPANELRDLANYIEAERNSGAKRPTFTSVHGGGSEIR
AADLTLDKFIDARTLAAADSIPHAPVPAQTVLLTGANGYLGRFLCLEWLE
RLDKTGGTLICVVRGSDAAAARKRLDSAFDSGDPGLLEHYQQLAARTLEV
LAGDIGDPNLGLDDATWQRLAETVDLIVHPAALVNHVLPYTQLFGPNVVG
TAEIVRLAITARRKPVTYLSTVGVADQVDPAEYQEDSDVREMSAVRVVRE
SYANGYGNSKWAGEVLLREAHDLCGLPVAVFRSDMILAHSRYAGQLNVQD
VFTRLILSLVATGIAPYSFYRTDADGNRQRAHYDGLPADFTAAAITALGI
QATEGFRTYDVLNPYDDGISLDEFVDWLVESGHPIQRITDYSDWFHRFET
AIRALPEKQRQASVLPLLDAYRNPCPAVRGAILPAKEFQAAVQTAKIGPE
QDIPHLSAPLIDKYVSDLELLQLL

Nucleotide sequence (SEQ ID NO:81)

>uniprot|Q741P9|Q741P9_MYCPA FadD9

ATGTCGACTGCCACCCATGACGAACGACTCGACCGTCGCGTCCACGAACTCATCGCCACC
GACCCGCAATTCGCCGCCGCCCAACCCGACCCGGCGATCACCGCCGCCCTCGAACAGCCC
GGGCTGCGGCTGCCGCAGATCATCCGCACCGTGCTCGACGGCTACGCCGACCGGCCGGCG
CTGGGACAGCGCGTGGTGGAGTTCGTCACGGACGCCAAGACCGGGCGCACGTCGGCGCAG
CTGCTCCCCCGCTTCGAGACCATCACGTACAGCGAAGTAGCGCAGCGTGTTTCGGCGCTG
GGCCGCGCCCTGTCCGACGACGCGGTGCACCCCGGCGACCGGGTGTGCGTGCTGGGCTTC
AACAGCGTCGACTACGCCACCATCGACATGGCGCTGGGCGCCATCGGCGCCGTCTCGGTG
CCGCTGCAGACCAGCGCGGCAATCAGCTCGCTGCAGCCGATCGTGGCCGAGACCGAGCCC
ACCCTGATCGCGTCCAGCGTGAACCAGCTGTCCGACGCGGTGCAGCTGATCACCGGCGCC
GAGCAGGCGCCCACCCGGCTGGTGGTGTTCGACTACCACCCGCAGGTCGACGACCAGCGC
GAGGCCGTCCAGGACGCCGCGGCGCGGCTGTCCAGCACCGGCGTGGCCGTCCAGACGCTG
GCCGAGCTGCTGGAGCGCGGCAAGGACCTGCCCGCCGTCGCGGAGCCGCCCGCCGACGAG
GACTCGCTGGCCCTGCTGATCTACACCTCCGGGTCCACCGGCGCCCCCAAGGGCGCGATG
TACCCACAGAGCAACGTCGGCAAGATGTGGCGCCGCGGCAGCAAGAACTGGTTCGGCGAG
AGCGCCGCGTCGATCACCCTGAACTTCATGCCGATGAGCCACGTGATGGGCCGAAGCATC
CTCTACGGCACGCTGGGCAACGGCGGCACCGCCTACTTCGCCGCCCGCAGCGACCTGTCC
ACCCTGCTTGAGGACCTCGAGCTGGTGCGGCCCACCGAGCTCAACTTCGTCCCGCGGATC
TGGGAGACGCTGTACGGCGAATTCCAGCGTCAGGTCGAGCGGCGGCTCTCCGAGGCCGGG
GACGCCGGCGAACGTCGCGCCGTCGAGGCCGAGGTGCTGGCCGAGCAGCGCCAGTACCTG
CTGGGCGGGCGGTTCACCTTCGCGATGACGGGCTCGGCGCCCATCTCGCCGGAGCTGCGC
AACTGGGTCGAGTCGCTGCTCGAAATGCACCTGATGGACGGCTACGGCTCCACCGAGGCC
GGAATGGTGTTGTTCGACGGGGAGATTCAGCGCCCGCCGGTGATCGACTACAAGCTGGTC
GACGTGCCGGACCTGGGCTACTTCAGCACCGACCGGCCGCATCCGCGCGGCGAGCTGCTG
CTGCGCACCGAGAACATGTTCCCGGGCTACTACAAGCGGGCCGAAACCACCGCGGGCGTC
TTCGACGAGGACGGCTACTACCGCACCGGCGACGTGTTCGCCGAGATCGCCCCGGACCGG
CTGGTCTACGTCGACCGCCGCAACAACGTGCTCAAGCTGGCGCAGGGCGAATTCGTCACG
CTGGCCAAGCTGGAGGCGGTGTTCGGCAACAGCCCGCTGATCCGCCAGATCTACGTCTAC
GGCAACAGCGCCCAGCCCTACCTGCTGGCGGTCGTGGTGCCCACCGAGGAGGCGCTGGCC
TCGGGTGACCCCGAGACGCTCAAGCCCAAGATCGCCGACTCGCTGCAGCAGGTCGCCAAG
GAGGCCGGCCTGCAGTCCTACGAGGTGCCGCGCGACTTCATCATCGAGACCACCCCGTTC
AGCCTGGAAAACGGTCTGCTGACCGGGATCCGGAAGCTGGCGTGGCCGAAACTGAAGCAG
CACTACGGGGAACGGCTGGAGCAGATGTACGCCGACCTGGCCGCCGGACAGGCCAACGAG
CTGGCCGAGCTGCGCCGCAACGGTGCCCAGGCGCCGGTGTTGCAGACCGTGAGCCGCGCC
GCGGGCGCCATGCTGGGTTCGGCCGCCTCCGACCTGTCCCCCGACGCCCACTTCACCGAT
CTGGGCGGAGACTCGTTGTCGGCGTTGACATTCGGCAACCTGCTGCGCGAGATCTTCGAC
GTCGACGTGCCGGTAGGCGTGATCGTCAGCCCGGCCAACGACCTGGCGGCCATCGCGAGC
TACATCGAGGCCGAGCGGCAGGGCAGCAAGCGCCCGACGTTCGCCTCGGTGCACGGCCGG
GACGCGACCGTGGTGCGCGCCGCCGACCTGACGCTGGACAAGTTCCTCGACGCCGAGACG
CTGGCCGCCGCGCCGAACCTGCCCAAGCCGGCCACCGAGGTGCGCACCGTGCTGCTGACC
GGCGCCACCGGCTTCCTGGGCCGCTACCTGGCCCTGGAATGGCTGGAGCGGATGGACATG
GTGGACGGCAAGGTCATCGCCCTGGTCCGGGCCCGCTCCGACGAGGAGGCACGCGCCCGG
CTGGACAAGACCTTCGACAGCGGCGACCCGAAACTGCTCGCGCACTACCAGCAGCTGGCC
GCCGATCACCTGGAGGTCATCGCCGGCGACAAGGGCGAGGCCAATCTGGGCCTGGGCCAA
GACGTTTGGCAACGACTGGCCGACACGGTCGACGTGATCGTCGACCCCGCCGCGCTGGTC
AACCACGTGTTGCCGTACAGCGAGCTGTTCGGCCCCAACGCCCTGGGCACCGCGGAGCTG
ATCCGGCTGGCGCTGACGTCCAAGCAGAAGCCGTACACCTACGTGTCCACCATCGGCGTG

FIG. 4 (Cont.)

GGCGACCAGATCGAGCCGGGCAAGTTCGTCGAGAACGCCGACATCCGGCAGATGAGCGCC
ACCCGGGCGATCAACGACAGCTACGCCAACGGCTATGGCAACAGCAAGTGGGCCGGCGAG
GTGCTGCTGCGCGAGGCGCACGACCTGTGCGGGCTGCCCGTCGCGGTGTTCCGCTGCGAC
ATGATCCTGGCCGACACCACGTATGCCGGGCAGCTCAACCTGCCGGACATGTTCACCCGG
CTGATGCTGAGCCTGGTGGCCACCGGGATCGCGCCCGGCTCGTTCTACGAGCTCGACGCC
GACGGCAACCGGCAGCGGGCGCACTACGACGGCCTGCCGGTCGAGTTCATCGCCGCGGCG
ATCTCGACGCTGGGTTCGCAGATCACCGACAGCGACACCGGCTTCCAGACCTACCACGTG
ATGAACCCCTACGATGACGGCGTCGGTCTGGACGAGTACGTCGATTGGCTGGTGGACGCC
GGCTATTCGATCGAGCGGATCGCCGACTACTCCGAATGGCTGCGGCGGTTCGAGACCTCG
CTGCGGGCCCTGCCGGACCGGCAGCGCCAGTACTCGCTGCTGCCGCTGCTGCACAACTAC
CGCACGCCGGAGAAGCCGATCAACGGGTCGATAGCTCCCACCGACGTGTTCCGGGCAGCG
GTGCAGGAGGCGAAAATCGGCCCCGACAAAGACATTCCGCACGTGTCGCCGCCGGTCATC
GTCAAGTACATCACCGACCTGCAGCTGCTCGGGCTGCTCTGA

Amino acid sequence (SEQ ID NO:82)

>uniprot|Q741P9|Q741P9_MYCPA FadD9

MSTATHDERLDRRVHELIATDPQFAAAQPDPAITAALEQPGLRLPQIIRT
VLDGYADRPALGQRVVEFVTDAKTGRTSAQLLPRFETITYSEVAQRVSAL
GRALSDDAVHPGDRVCVLGFNSVDYATIDMALGAIGAVSVPLQTSAAISS
LQPIVAETEPTLIASSVNQLSDAVQLITGAEQAPTRLVVFDYHPQVDDQR
EAVQDAAARLSSTGVAVQTLAELLERGKDLPAVAEPPADEDSLALLIYTS
GSTGAPKGAMYPQSNVGKMWRRGSKNWFGESAASITLNFMPMSHVMGRSI
LYGTLGNGGTAYFAARSDLSTLLEDLELVRPTELNFVPRIWETLYGEFQR
QVERRLSEAGDAGERRAVEAEVLAEQRQYLLGGRFTFAMTGSAPISPELR
NWVESLLEMHLMDGYGSTEAGMVLFDGEIQRPPVIDYKLVDVPDLGYFST
DRPHPRGELLLRTENMFPGYYKRAETTAGVFDEDGYYRTGDVFAEIAPDR
LVYVDRRNNVLKLAQGEFVTLAKLEAVFGNSPLIRQIYVYGNSAQPYLLA
VVVPTEEALASGDPETLKPKIADSLQQVAKEAGLQSYEVPRDFIIETTPF
SLENGLLTGIRKLAWPKLKQHYGERLEQMYADLAAGQANELAELRRNGAQ
APVLQTVSRAAGAMLGSAASDLSPDAHFTDLGGDSLSALTFGNLLREIFD
VDVPVGVIVSPANDLAAIASYIEAERQGSKRPTFASVHGRDATVVRAADL
TLDKFLDAETLAAAPNLPKPATEVRTVLLTGATGFLGRYLALEWLERMDM
VDGKVIALVRARSDEEARARLDKTFDSGDPKLLAHYQQLAADHLEVIAGD
KGEANLGLGQDVWQRLADTVDVIVDPAALVNHVLPYSELFGPNALGTAEL
IRLALTSKQKPYTYVSTIGVGDQIEPGKFVENADIRQMSATRAINDSYAN
GYGNSKWAGEVLLREAHDLCGLPVAVFRCDMILADTTYAGQLNLPDMFTR
LMLSLVATGIAPGSFYELDADGNRQRAHYDGLPVEFIAAAISTLGSQITD
SDTGFQTYHVMNPYDDGVGLDEYVDWLVDAGYSIERIADYSEWLRRFETS
LRALPDRQRQYSLLPLLHNYRTPEKPINGSIAPTDVFRAAVQEAKIGPDK
DIPHVSPPVIVKYITDLQLLGLL

Q7D6X4

Nucleotide sequence (SEQ ID NO:83)

>uniprot|Q7D6X4|Q7D6X4_MYCTU Substrate--CoA ligase, putative

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC

FIG. 4 (Cont.)

CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG
CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACG
CTTTCCAACGGCGGTACCGCCTACTTCGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTG
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCTTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCGCCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACGCCTCGCTGCTGCCCTTGCTGCACAACTACCGAGAGCCTGCAAAG

FIG. 4 (Cont.)

CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA

Amino acid sequence (SEQ ID NO:84)

>uniprot|Q7D6X4|Q7D6X4_MYCTU Substrate--CoA ligase, putative

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIRPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHASLLPLLHNYREPAKPICGSIAPTDQFRAAVQEAKIGPDKDIPHL
TAAIIAKYISNLRLLGLL

Q7TY99

Nucleotide sequence (SEQ ID NO:85)

>uniprot|Q7TY99|Q7TY99_MYCBO PROBABLE FATTY-ACID-CoA LIGASE FADD9 (FATTY-ACID-COA SYNTHETASE) (FATTY-ACID-COA SYNTHASE)

ATGTCGATCAACGATCAGCGACTGACACGCCGCGTCGAGGACCTATACGCCAGCGACGCC
CAGTTCGCCGCCGCCAGTCCCAACGAGGCGATCACCCAGGCGATCGACCAGCCCGGGGTC
GCGCTTCCACAGCTCATCCGTATGGTCATGGAGGGCTACGCCGATCGGCCGGCACTCGGC
CAGCGTGCGCTCCGCTTCGTCACCGACCCCGACAGCGGCCGCACCATGGTCGAGCTACTG
CCGCGGTTCGAGACCATCACCTACCGCGAACTGTGGGCCCGCGCCGGCACATTGGCCACC
GCGTTGAGCGCTGAGCCCGCGATCCGGCCGGGCGACCGGGTTTGCGTGCTGGGCTTCAAC
AGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACG
ATGATCGCCACCAGCATCGACAATCTTGGCGACGCCGTCGAAGTGCTGGCCGGTCACGCC
CCGGCCCGGCTGGTCGTATTCGATTACCACGGCAAGGTTGACACCCACCGCGAGGCCGTC
GAAGCCGCCCGAGCTCGGTTGGCCGGCTCGGTGACCATCGACACACTTGCCGAACTGATC
GAACGCGGCAGGGCGCTGCCGGCCACACCCATTGCCGACAGCGCCGACGACGCGCTGGCG

FIG. 4 (Cont.)

CTGCTGATTTACACCTCGGGTAGTACCGGCGCACCCAAAGGCGCCATGTATCGCGAGAGC
CAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACG
CTTTCCAACGGCGGTACCGCCTACTACGTCGCCAAGAGCGACCTGTCGACGCTGTTCGAG
GACCTCGCCCTGGTGCGGCCCACAGAATTGTGCTTCGTGCCGCGCATCTGGGACATGGTG
TTCGCAGAGTTCCACAGCGAGGTCGACCGCCGCTTGGTGGACGGCGCCGATCGAGCGGCG
CTGGAAGCGCAGGTGAAGGCCGAGCTGCGGGAGAACGTGCTCGGCGGACGGTTTGTCATG
GCGCTGACCGGTTCCGCGCCGATCTCCGCTGAGATGACGGCGTGGGTCGAGTCCCTGCTG
GCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGC
TACTTCGGCACCGATCAGCCCTACCCCCGGGGCGAGCTGCTGGTCAAGACGCAAACCATG
TTCCCCGGCTACTACCAGCGCCCGGATGTCACCGCCGAGGTGTTCGACCCCGACGGCTTC
TACCGGACCGGGGACATCATGGCCAAAGTAGGCCCCGACCAGTTCGTCTACCTCGACCGC
CGCAACAACGTGCTAAAGCTCTCCCAGGGCGAGTTCATCGCCGTGTCGAAGCTCGAGGCG
GTGTTCGGCGACAGCCCGCTGGTCCGACAGATCTTCATCTACGGCAACAGTGCCCGGGCC
TACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCC
TACGAGATTCCACGCGACTTCATCATCGAAACCACGCCGTTCACCCTGGAGAACGGCCTA
CTCACCGGCATCCGCAAGCTGGCACGCCCGCAGTTGAAGAAGTTCTATGGCGAACGTCTC
GAGCGGCTCTATACCGAGCTGGCCGATAGCCAATCCAACGAGCTGCGCGAGCTGCGGCAA
AGCGGTCCCGATGCGCCGGTGCTTCCGACGCTGTGCCGTGCCGCGGCTGCGTTGCTGGGC
TCTACCGCTGCGGATGTGCGGCCGGACGCGCACTTCGCCGACCTGGGTGGTGACTCGCTC
TCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGC
ACCGGCGTCAGGCGACCCAGCTTCGCCTCGATACACGGTCGCTCCGCGACGGAAGTGCAC
GCCAGCGACCTCACGCTGGACAAGTTCATCGACGCTGCCACCCTGGCCGCAGCCCCGAAC
CTGCCGGCACCGAGCGCCCAAGTGCGCACCGTACTGCTGACCGGCGCCACCGGCTTTTTG
GGTCGCTACCTGGCGCTGGAATGGCTCGACCGCATGGACCTGGTCAACGGCAAGCTGATC
TGCCTGGTCCGCGCCAGATCCGACGAGGAAGCACAAGCCCGGCTGGACGCGACGTTCGAT
AGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTA
GCCGACACGGTGGACCTGATCGTGGACCCCGCGGCCCTGGTCAACCACGTGCTGCCGTAT
AGCCAGCTGTTCGGCCCAAACGCGGCGGGCACCGCCGAGTTGCTTCGGCTGGCGCTGACC
GGCAAGCGCAAGCCATACATCTACACCTCGACGATCGCCGTGGGCGAGCAGATCCCGCCG
GAGGCGTTCACCGAGGACGCCGACATCCGGGCCATCAGCCCGACCCGCAGGATCGACGAC
AGCTACGCCAACGGCTACGCGAACAGCAAGTGGGCCGGCGAGGTGCTGCTGCGCGAAGCT
CACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCC
GCTACCGGCATCGCACCCGGTTCGTTCTATGAGCTGGATGCGCACGGCAATCGGCAACGC
GCCCACTATGACGGCTTGCCGGTCGAATTCGTCGCAGAAGCCATTTGCACCCTTGGGACA
CATAGCCCGGACCGTTTTGTCACCTACCACGTGATGAACCCCTACGACGACGGCATCGGG
CTGGACGAGTTCGTCGACTGGCTCAACTCCCCAACTAGCGGGTCCGGTTGCACGATCCAG
CGGATCGCCGACTACGGCGAGTGGCTGCAGCGGTTCGAGACTTCGCTGCGTGCCTTGCCG
GATCGCCAGCGCCACACCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAA
ATCGGTCCGGACAAAGACATTCCGCACCTCACGGCGGCGATCATCGCGAAGTACATCAGC
AACCTGCGACTGCTCGGGCTGCTGTGA

FIG. 4 (Cont.)

Amino acid sequence (SEQ ID NO:.86)

>uniprot|Q7TY99|Q7TY99_MYCBO PROBABLE FATTY-ACID-CoA LIGASE FADD9 (FATTY-ACID-COA SYNTHETASE) (FATTY-ACID-COA SYNTHASE)

MSINDQRLTRRVEDLYASDAQFAAASPNEAITQAIDQPGVALPQLIRMVM
EGYADRPALGQRALRFVTDPDSGRTMVELLPRFETITYRELWARAGTLAT
ALSAEPAIRPGDRVCVLGFNSVDYTTIDIALIRLGAVSVPLQTSAPVTGL
RPIVTETEPTMIATSIDNLGDAVEVLAGHAPARLVVFDYHGKVDTHREAV
EAARARLAGSVTIDTLAELIERGRALPATPIADSADDALALLIYTSGSTG
APKGAMYRESQVMSFWRKSSGWFEPSGYPSITLNFMPMSHVGGRQVLYGT
LSNGGTAYYVAKSDLSTLFEDLALVRPTELCFVPRIWDMVFAEFHSEVDR
RLVDGADRAALEAQVKAELRENVLGGRFVMALTGSAPISAEMTAWVESLL
ADVHLVEGYGSTEAGMVLNDGMVRRPAVIDYKLVDVPELGYFGTDQPYPR
GELLVKTQTMFPGYYQRPDVTAEVFDPDGFYRTGDIMAKVGPDQFVYLDR
RNNVLKLSQGEFIAVSKLEAVFGDSPLVRQIFIYGNSARAYPLAVVVPSG
DALSRHGIENLKPVISESLQEVARAAGLQSYEIPRDFIIETTPFTLENGL
LTGIRKLARPQLKKFYGERLERLYTELADSQSNELRELRQSGPDAPVLPT
LCRAAAALLGSTAADVRPDAHFADLGGDSLSALSLANLLHEIFGVDVPVG
VIVSPASDLRALADHIEAARTGVRRPSFASIHGRSATEVHASDLTLDKFI
DAATLAAAPNLPAPSAQVRTVLLTGATGFLGRYLALEWLDRMDLVNGKLI
CLVRARSDEEAQARLDATFDSGDPYLVRHYRELGAGRLEVLAGDKGEADL
GLDRVTWQRLADTVDLIVDPAALVNHVLPYSQLFGPNAAGTAELLRLALT
GKRKPYIYTSTIAVGEQIPPEAFTEDADIRAISPTRRIDDSYANGYANSK
WAGEVLLREAHEQCGLPVTVFRCDMILADTSYTGQLNLPDMFTRLMLSLA
ATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALP
DRQRHTSLLPLLHNYREPAKPICGSIAPTDQFRAAVQEAKIGPDKDIPHL
TAAIIAKYISNLRLLGLL

<u>Q9CCT4</u>

Nucleotide sequence (SEQ ID NO:87)

>uniprot|Q9CCT4|Q9CCT4_MYCLE Putative acyl-CoA synthetase

GTGTGGCGCCAACAGTCTATTTCTCATCGCAAGGAATCTGTTATGTCGACTATCACTAAG
CAGGAAAAGCAGCTCGCACGCCGCGTTGACGACCTCACCGCCAACGACCCGCAGTTCGCC
GCCGCCAAACCCGACCCGGCGGTAGCCGCCGCCCTTGCCCAGCCCGGGCTTCGACTGCCC
CAAATCATCCAGACCGCGCTGGACGGTTACGCGGAGCGGCCGGCACTGGGCCAGCGCGTC
GCCGAGTTCACCAAAGACCCTAAGACCGGACGCACCTCGATGGAGCTGCTCCCCAGCTTT
GAGACCATCACCTACCGCCAGTTGGGCGACCGTGTCGGAGCGCTGGCGCGCGCCTGGAGG
CACGACCTACTGCACGCCGGCTACCGGGTCTGCGTGCTAGGTTTCAACAGTGTCGATTAC
GCCATCATCGACATGGCGCTCGGCGTGATTGGTGCTGTGGCGGTTCCACTGCAGACCAGT
GCGGCGATCACCCAGCTGCAGTCGATCGTGACCGAGACCGAACCCAGTATGATCGCGACG
AGCGTAAACCAGCTGCCCGATACTGTCGAGCTGATCCTGTCTGGCCAGGCGCCAGCGAAG
CTCGTTGTGTTTGACTACCACCCCGAGGTCGACGAGCAGCATGACGCAGTGGCAACCGCC
CGGGCGCGGTTGGCGGACAGTAGCGTGGTGGTCGAGAGCCTGACCGAGGTCCTCGGTCGC
GGCAAGACGCTGCCAGCTACGCCGATCCCCGTGGCCGATGACTCTGCTGACCCGTTGGCG
TTGCTGATCTACACATCTGGCAGCACCGGCGCACCCAAGGGCGCGATGTATCTGCAAAGC
AATGTCGGCAAGATGTGGCGCCGGTCAGACGGAAACTGGTTCGGGCCAACCGCCGCGTCA
ATCACTCTTAACTTCATGCCGATGAGCCACGTCATGGGCCGCGGAATCCTCTACGGCACG

FIG. 4 (Cont.)

CTCGGTAACGGCGGCACGGCTTACTTCGCCGCCCGCAGCGACCTCTCGACGCTGCTGGAG
GATCTCAAGCTGGTGCGGCCGACCGAGTTGAACTTTGTACCGCGCATCTGGGAAACCCTC
TACGATGAATCCAAACGCGCAGTTGACCGTCGGTTAGCCAACAGCGGCTCCGCCGACCGT
GCAGCCATCAAAGCCGAAGTTATGGATGAACAGCGGCAATCCCTGCTGGGAGGACGGTAC
ATCGCGGCTATGACGGGCTCGGCGCCAACCTCCCCGGAGTTGAAACACGGGGTCGAGTCC
CTACTCGAAATGCATCTGTTGGAAGGCTACGGCTCCACCGAAGCCGGCATGGTCTTGTTT
GACGGCGAAGTGCAACGTCCGCCGGTTATCGATTACAAGCTGGTCGACGTTCCGGATTTG
GGCTACTTCAGCACCGACCAGCCTTATCCGAGAGGTGAATTGCTGCTCAAGACCCAGAAC
ATGTTCCCCGGCTACTACAAGCGTCCTGAGGTTACCGCCACCGTGTTCGACAGCGACGGT
TACTACCAGACCGGAGACATTGTCGCCGAAGTCGGTCCCGACCGGCTCGTGTACGTCGAT
CGCCGCAACAACGTGCTGAAACTCGCGCAGGGCCAGTTCGTCACCGTCGCGAAACTCGAG
GCAGCGTTCAGCAATAGCCCACTGGTCCGGCAGATCTACATCTATGGCAACAGCGCACAC
CCCTACCTGTTGGCTGTTGTGGTGCCGACCGAGGATGCGTTGGCTACCAATGACATTGAG
GTGCTCAAACCGCTGATTATCGATTCTTTACAGAAAGTAGCGAAAGAAGCCGACCTGCAG
TCCTACGAGGTGCCGCGCGACTTAATCGTCGAGACTACACCGTTCAGCCTGGAGAATGGC
CTGCTCACCGGTATTCGCAAGCTGGCGTGGCCGAAGCTCAAGCAGCACTACGGCGCGCGA
CTCGAACAGCTCTACGCCGATCTGGTTGAAGGTCAGGCAAATGCACTGCACGTGCTAAAA
CAAAGCGTGGCGAACGCTCCGGTACTGCAGACGGTGAGCCGAGCCGTGGGCACCATTCTG
GGAGTGGCGACCACCGATTTGCCGTCGAATGCGCACTTCACCGACTTAGGAGGAGACTCG
TTGTCCGCGCTGACATTCGGTAGCCTGCTACGCGAACTCTTCGACATCGATGTGCCGGTG
GGCGTCATTGTCAGCCCTGTCAACAACTTGGTGGCGATCGCCGACTACATCGAGCGCGAG
CGGCAGGGCACGAAGCGGCCCACTTTCATTGCCATACACGGTCGTGACGCTGGCAAAGTG
CATGCCAGTGACCTCACTCTAGACAAATTCATCGATGTATCAACGCTGACTGCCGCGCCC
GTATTGGCGCAACCCGGCACCGAGGTGCGCACCGTCCTGTTGACCGGCGCTACCGGCTTC
CTGGGGCGCTACTTGGCCCTGAAATGGCTCGAACGGATGGACCTGGTCGAAGGGAAGGTA
ATCGCTCTGGTAAGAGCCAAGTCCAACGAGGACGCTCGGGCCCGGCTCGACAAGACCTTC
GATAGCGGAGACCCCAAACTGCTGGCGCACTACCAGGAACTGGCAACCGACCACCTGGAG
GTCATCGCCGGCGACAAAGGCGAAGTAGATCTGGAATTGGACCGGCAAACGTGGCGACGA
CTGGCCGACACGGTCGATCTGATCGTCGACCCCGCCGCCCTGGTCAACCACGTGCTGCCG
TACAGCGAGCTATTCGGCCCCAATACGTTAGGCACCGCCGAGCTGATTCGGATCGCGCTG
ACCAGTAAGCAAAAGCCGTACATCTATGTGTCGACAATCGGCGTCGGTAATCAGATTGAG
CCAGCAAAATTCACCGAAGACTCCGACATCCGAGTCATTAGCCCGACGCGCAACATCAAC
AACAACTATGCCAACGGCTACGGCAACAGCAAGTGGGCCGGCGAAGTGCTGCTGCGCGAA
GCTCACGACCTATGCGGTCTGCCGGTCACGGTCTTCCGCTGCGACATGATCTTGGCCGAC
ACCAGCTATGCCGGTCAGCTCAACGTCCCCGACATGTTTACTCGAATGATGCTGAGTCTA
GCCGCCACCGGCATCGCACCCGGCTCGTTCTACGAGCTAGACGCCGAGAGCAATCGGCAA
CGCGCCCACTACGACGGTCTGCCCGTCGAGTTCATCGCCGAAGCGATCTCCACCCTGGGA
GACCAAAGCCTGCACGATCGAGACGGGTTCACGACCTATCATGTAATGAACCCGCACGAC
GACGGCATCGGTATGGACGAGTTTGTGGACTGGTTAATTGATGCCGGCTGCCCTATACAA
CGCATCAACGACTACGACGAATGGCTGCGACGGTTTGAGATTTCGCTGCGCGCCCTGCCC
GAAAGGCAGCGTCACAGCTCACTGTTGCCGTTGTTGCACAACTACCAGAAGCCGGAGAAG
CCATTGCACGGGTCGCTGGCACCCACAATCCGGTTCCGTACGGCCGTTCAAAACGCGAAC
ATTGGTCAGGACAAAGATATTCCGCATATCTCGCCGGCAATCATCGCCAAATATGTCAGC
GATCTGCAGCTGCTCGGGCTGGTTTGA

Amino acid sequence (SEQ ID NO:88)

>uniprot|Q9CCT4|Q9CCT4_MYCLE Putative acyl-CoA synthetase

VWRQQSISHRKESVMSTITKQEKQLARRVDDLTANDPQFAAAKPDPAVAA
ALAQPGLRLPQIIQTALDGYAERPALGQRVAEFTKDPKTGRTSMELLPSF
ETITYRQLGDRVGALARAWRHDLLHAGYRVCVLGFNSVDYAIIDMALGVI

FIG. 4 (Cont.)

GAVAVPLQTSAAITQLQSIVTETEPSMIATSVNQLPDTVELILSGQAPAK
LVVFDYHPEVDEQHDAVATARARLADSSVVVESLTEVLGRGKTLPATPIP
VADDSADPLALLIYTSGSTGAPKGAMYLQSNVGKMWRRSDGNWFGPTAAS
ITLNFMPMSHVMGRGILYGTLGNGGTAYFAARSDLSTLLEDLKLVRPTEL
NFVPRIWETLYDESKRAVDRRLANSGSADRAAIKAEVMDEQRQSLLGGRY
IAAMTGSAPTSPELKHGVESLLEMHLLEGYGSTEAGMVLFDGEVQRPPVI
DYKLVDVPDLGYFSTDQPYPRGELLLKTQNMFPGYYKRPEVTATVFDSDG
YYQTGDIVAEVGPDRLVYVDRRNNVLKLAQGQFVTVAKLEAAFSNSPLVR
QIYIYGNSAHPYLLAVVVPTEDALATNDIEVLKPLIIDSLQKVAKEADLQ
SYEVPRDLIVETTPFSLENGLLTGIRKLAWPKLKQHYGARLEQLYADLVE
GQANALHVLKQSVANAPVLQTVSRAVGTILGVATTDLPSNAHFTDLGGDS
LSALTFGSLLRELFDIDVPVGVIVSPVNNLVAIADYIERERQGTKRPTFI
AIHGRDAGKVHASDLTLDKFIDVSTLTAAPVLAQPGTEVRTVLLTGATGF
LGRYLALKWLERMDLVEGKVIALVRAKSNEDARARLDKTFDSGDPKLLAH
YQELATDHLEVIAGDKGEVDLELDRQTWRRLADTVDLIVDPAALVNHVLP
YSELFGPNTLGTAELIRIALTSKQKPYIYVSTIGVGNQIEPAKFTEDSDI
RVISPTRNINNNYANGYGNSKWAGEVLLREAHDLCGLPVTVFRCDMILAD
TSYAGQLNVPDMFTRMMLSLAATGIAPGSFYELDAESNRQRAHYDGLPVE
FIAEAISTLGDQSLHDRDGFTTYHVMNPHDDGIGMDEFVDWLIDAGCPIQ
RINDYDEWLRRFEISLRALPERQRHSSLLPLLHNYQKPEKPLHGSLAPTI
RFRTAVQNANIGQDKDIPHISPAIIAKYVSDLQLLGLV

Q54JK0

Nucleotide sequence (SEQ ID NO:89)

>uniprot|Q54JK0|Q54JK0_DICDI Putative uncharacterized protein

ATGTTAAAACATATTAAAAATTTTTTAACTAGAAAAGAAGAAAGAAAAGAAAAAGAAGTA
GAGAAATTAAAAGATGGAGTATCAATAACTGAGGTTAAACAATCGAACCTAGTAGTTTAT
TCATGCAATGGTTGTGGATCAGAGATATGGCCACCAAAACAAGAGAGATATGCATGTAAT
GAATGCTCAAATTTCGATTTATGTAGTGAGTGTTATAGAAAAGAAATGATATTAATAAAT
GGTACACAAGAAGAGAAAGATAAATTAGTTAGTGGGGAGAGTAATAATGGAATAAAGTAC
GAGCCAGTGAGACATTATGATCCATCACCATTACCTCATCAATTAACATTAGAGAATGAG
ACTCAATTTCAATTAGTTTATAGTTTACGTGGTAATTCAACATTTGAAACAATGGAGAAA
TCATTTAAATACTTTAAAAACAGACCATGTCTTGGTATTAGAGAGAGATTAGGAGAGGAT
AATGTTTTATCAGAAAGATATAAATGGTTAACATATGGTGAAGTGTATGAGAAATCTTTA
ACCTTGGCAAAGGCATTAACTAATTTCATCGAAAGAAGAGATTTCATTTCAATCTATATG
GATAATTGCTTAGAATGGTATTTCACAGATTTTGCATCATTATGGGCCGGATTAATAGTG
GTACCATTACATCATGCTTCAAATAGTTTTAATCTTTTAGAGATTCTTTGGAATTCCGAA
TCAAAATGTATAGTTTGTTCTGGTGAATCATTTAAAAATTTAATAGAACTTTATGATCAA
TTGACTGAGCAAGATAAATTAGAGAAACCAATAGTGTTGAAATTGATAGTTCATAAGGAG
GATCTATTCGATCAGTCATTAGTCGATAGATTGCCAAGTGGCGTAGAATTTAAAACTTTC
AATGAGATGATTAAAATTGGGGAATCATTAAGTCAGGCTAAATATGAATTTGTCCCAGTT
GGTCCAAATGATCTTTCCTCGGTGACTTATACAAGTGGTAGTACTGGTGTACCAAAAGGT
GTAATGAAGTTAGATTCAATTTTCAATTTACTAATTGTCAATTCCTATGTTCAATTCCCA
AATGCAGTTTATAGTTATAATACCCTATCACATAGTCAACGTTTAAGTGATTGGAGATAT
ATTTATATGGGTGGTAGAGTAGCTATCTATTCAGGTGATATGAATCTATTATTTGAAGAT
TTAGCCTTGGTTAGACCTCATTCATTTTGGGCTGTACCAAGATTTTGGAATTTATTATTC
ACCCAGTTCAAGAGTGATCTAAAGCAATACATGTTTGAAAATCCACAATTGGATGAAAGA
ACTGCCACACTCTATTGCTATAAAGGTATTAGAAAGTTATTAGGTGATAGAATTAATAAT
CTAGTGACTGGTGGTGCTCCGACTGCAAATGAAGTACTCAAATTTATGAGTGATTGTTGG

FIG. 4 (Cont.)

AAAGATATAAACATTTCAAATTCTTATGGTTTAACTGAAGTATCAGGTGTTTGTATAGAT
GGTTATATCTCTGACGAAGTAGAATTCAAAATTGAACCAGTACCTTCTTTTGGATATTAC
CCAACTGATTTACCACATCCTCGTGGTGAATTGGTTGTAAAATCATCAACAATGTCTGCA
GGTTATTATAAAAATACTCAATTAACTTCAGAATCATTTGAAGGTGGTTGGTTTAAAACT
GGTGATGTCGTAGAATTAATTGGAGTTAGAAAAGTTAAAATCATTGATAGAATTAAACAT
GCCTTCAAATTGGCAAATGGAGAATTCGTTACACCAGAACCATTGGAAAATAATTTCGTT
TCACTTTGTATTAATCAAATTTTTATTTATGGTAATTCACTTAAAACATTTTTAGTTGCA
ATTGTTAAACCATCACAAGATTGTTTAAAACAATTAGGACTTCAAGATATACCAATCGAT
CAATTAATTGAAAATCCAACTTTAAAATCAAAACTTTTATCAGAGATTAATAAAATTTCA
AAAGAAAAAAAACTAGCAAATTATGAAATTCCAAAAATTATTACAATAGATTTCACTGAA
TGGACAATTGATAATAAATTAATCACTGGTTCTGGTAAATTTAATAGAGGTGAATTATAT
AAATTTTATAAAATTAAAATTAATAATATGTTTGATATAATTGATAAAATTCAACAAGGT
TTAAGAAATAATAATAATAATAATAATAATGATAATATTAATAATAATGATAATAATAAT
AATAATGAATCAAATAAAGATAATTTTGAAAATTATATAAAATCAATTTTAAATTTAGAC
GGTAGAATTGAAGATAATAATTTTAATTTAGAGAATTTATCATTTATTCAAATTGGTGGT
GATTCGTTAGGTGCTGTTAAATTATCATCACTTTTAAAAGAAAAAGAAAATATTGATATT
TCACCTTCAACAATTTTAAATCAAAATTTTAATTTATCTTCATTATCGAAATTAATAAAT
GAAAAAGAATCAAATCAATCAATTGTTGAAGATTTTAAAGAAAATTTTAAAATCAATTGG
AATGAAGAGATGATTTTAGATGAAGATATTAAAAAATCAATTGACCAAATTAAAAATGCA
CAACCATCATCAACTCCCTCTTCATCAAAATCAACACCATCACAATCATCATCATCACCA
CCACCATCATTAAATTCAAATAATATTGGTCAAAATGCTTTTCATATGAAATCAATATTT
ATTACAGGTGTTACAGGTTATTTAGGTACATTTTTATTATTTAATTTATTAGAGGATAAA
TCAATTGGTATTGAGAGAATTTATTGTTTAGTTAGAAATGTAAAGAATGAAGAAGAAGGT
TTTAAATTAATTGAAAGAATATTTGAAAAATCTTGTATCAATGGTATGAATGAAAAGATT
AGAGAAAAGGTAATTCCAGTTTGTGGTGACTTATCAAAACCATTTTTCGGTGTTTCTACT
GAAACCTTCAAAATGTTATCTTTAGCGGTCGATATGGTAATTCACAATGGTGCCATTGTT
AATATGGCCTATCCATATGCGAATATGAAATCAACAAATGTTACATCAACTCGTGATATC
CTAAGATTATGCACTACCGGAAGAGCCTCTTTTAAAAAGTTGGTCTACGTTTCAACAGTT
GGTGTATTCTTTGGAAATGGTGATGAAAAGATAGATGAATCAACAGCACCATCAACTTTC
TTTTTAGATCATGGTAATGGTTATAACCAAACAAAACTAATATCAGATATACTTGTTAGA
GAAGCGGCTTCATATGGTTTACCAACAATGATTTTCAGACCAGGTACAATCTTTAGTCAT
ACCCAATCTGGTTTCAACAATCAAAATGATTCAATCGGTTTAATAATTAAAGGTATCCTA
GGTTCGAGTTCCTATCCAACTAAAAAAGATTACTCTAGTGGCGATTTAAATCTTTCACCA
GTTGATTGGGTATCATCTTCAATGGTTTCTTTAATTAAGCATCTTCCATTTTGGTGTAAT
AATACAAAAATTTATCATATGGTAAATGATAATCGTTTATCTTTAGATTTGCTATGTCAA
TATATAAATAAAGAAAAACAATTAGAAGAAATTAATTATTTCGATTGGATCGATGCTCAA
CTTAATTCTTCAAATAATCCATTGTATTCTATTAAACATTTATTTAAAAAGAATGATCGT
TTCCCAATTGGTTCTCAGTCAATTAAAAATCCAAAAACTATTAAAGATTTAGAATCAATT
GGTGAACTTCAATGTCAACCAATATCTGATTCCACAGTAATCAATTATGTAAAATATTTA
ATCTCAAATAATTTAATTCAAACAATTAATAAATAA

Amino acid sequence (SEQ ID NO:90)

>uniprot|Q54JK0|Q54JK0_DICDI Putative uncharacterized protein

MLKHIKNFLTRKEERKEKEVEKLKDGVSITEVKQSNLVVYSCNGCGSEIWPPKQERYACNECSN
FDLCSECYRKEMILINGTQEEKDKLVSGESNNGIKYEPVRHYDPSPLPHQLTLENETQFQLVYSL
RGNSTFETMEKSFKYFKNRPCLGIRERLGEDNVLSERYKWLTYGEVYEKSLTLAKALTNFIERRD
FISIYMDNCLEWYFTDFASLWAGLIVVPLHHASNSFNLLEILWNSESKCIVCSGESFKNLIELYDQL
TEQDKLEKPIVLKLIVHKEDLFDQSLVDRLPSGVEFKTFNEMIKIGESLSQAKYEFVPVGPNDLSS
VTYTSGSTGVPKGVMKLDSIFNLLIVNSYVQFPNAVYSYNTLSHSQRLSDWRYIYMGGRVAIYSG
DMNLLFEDLALVRPHSFWAVPRFWNLLFTQFKSDLKQYMFENPQLDERTATLYCYKGIRKLLGD

FIG. 4 (Cont.)

RINNLVTGGAPTANEVLKFMSDCWKDINISNSYGLTEVSGVCIDGYISDEVEFKIEPVPSFGYYPT
DLPHPRGELVVKSSTMSAGYYKNTQLTSESFEGGWFKTGDVVELIGVRKVKIIDRIKHAFKLANG
EFVTPEPLENNFVSLCINQIFIYGNSLKTFLVAIVKPSQDCLKQLGLQDIPIDQLIENPTLKSKLLSEI
NKISKEKKLANYEIPKIITIDFTEWTIDNKLITGSGKFNRGELYKFYKIKINNMFDIIDKIQQGLRNNNN
NNNNDNINNNDNNNNNESNKDNFENYIKSILNLDGRIEDNNFNLENLSFIQIGGDSLGAVKLSSLL
KEKENIDISPSTILNQNFNLSSLSKLINEKESNQSIVEDFKENFKINWNEEMILDEDIKKSIDQIKNAQ
PSSTPSSSKSTPSQSSSSPPPSLNSNNIGQNAFHMKSIFITGVTGYLGTFLLFNLLEDKSIGIERIY
CLVRNVKNEEEGFKLIERIFEKSCINGMNEKIREKVIPVCGDLSKPFFGVSTETFKMLSLAVDMVIH
NGAIVNMAYPYANMKSTNVTSTRDILRLCTTGRASFKKLVYVSTVGVFFGNGDEKIDESTAPSTF
FLDHGNGYNQTKLISDILVREAASYGLPTMIFRPGTIFSHTQSGFNNQNDSIGLIIKGILGSSSYPTK
KDYSSGDLNLSPVDWVSSSMVSLIKHLPFWCNNTKIYHMVNDNRLSLDLLCQYINKEKQLEEINY
FDWIDAQLNSSNNPLYSIKHLFKKNDRFPIGSQSIKNPKTIKDLESIGELQCQPISDSTVINYVKYLI
SNNLIQTINK

Q2MFQ3

Nucleotide sequence (SEQ ID NO:91)

>uniprot|Q2MFQ3|Q2MFQ3_STRRY Putative non-ribosomal peptide synthetase

ATGACCGACACGTACGTTTCTTCACGCCCGTTATCCAAGCGGCCCCAGGTCCCGGGTGCC
CGCACGCCGGCGCCCGGCTACCCACGGACAGCCGCATCCCGGAGCTGTTCGAGGCACAG
GCCGCGGCGCTGCCGCAGGCCCCGGCGGCCCGGCACGGGGACCGCACCCTGACCTACGGC
CAACTCGACGCCCACGCCGACGCGTTGGCGGACCGGCTGGCTGCCGGCGGGGTCCGGCCG
GGTGACCTGATCGGCGTGTGCGGCAGCCGTTCCCTGGAGGCGCTGGTGGCGCTGCTGGGC
ATCCTCAAGGCCGGCTGCGCGTACGTACCGCTCGACGAGGAACTGCCGCCGGCCCGGCTG
CGGGCCATGGCCGAGGACGCGGGCATCAGCGCCGCGGTCACCCTGCCGGGCAGCACGCGC
CGGGTGCGGGGTCTACGCGTGTCAGTCGAGGTCGGCTCCCTCGGCCGGCCCGCCCCCGAG
CGCGCGAGCGGCCCCGCCCCCGACCGGGCCACCGGCTCCGCCGCCGACTGCGCCTACGTC
GCCTTCACTTCCGGCACGACCGGCCGGCCCAAGCCCGTAGCGCTGTCCCACCGGGGCGTG
GTCCGCCTCGTGCTGTCCGACCCCGGCCTCACGCCACCCGGACCGGGCGACGGAGTGCTG
CACGCCTACAGCCTGTCCTCCGACGCCTCGACCATCGAGATCTGGGGCGCGCTGCTGACC
GGCGCCTGCCTGGTCGTCGCCGACCGCGAGGAACTGCTCTCGCCCACCGCCCTGGAACGG
CTGCTCCGCGCGGGCGGCGTCACCGTGGCGTACCTGACGACGAGCGTCTTCCACCTCGTC
GCCCGGACCCGCCCCGAGGCGCTGGCCGGCCTGCGGTTCGTCTCCGCGGGCGGGGAGGCG
ATGGACCCGCGCCTGGCGAACGCCGTCCTCGCGGCCTGCCCCCGCACCACGGTGGTCAAC
TTCTACGGCCCGACCGAGAACGCCGTGGTCTCCACCGCCCATGTGCTCACCCCCCTCCCC
GAGGACGCCGCACACGTCCCCCTGGGACGCCCCTTCGGCGCTTCCACCTGCCACGTCCTG
CGGGCCGACGGCTCGCCCGCGCGGCCGGGCGAGGAAGGGGAGCTGTACGTCGGCGGGGAC
GGGCTGGCGCTGGGCTACCTCGGCGACCCGCAGCTGACCGCCGAGCGGTTCGTGACGCTG
CCCGCGGTCGAGCCGGACGGACCGCTGTACCGGACCGGCGACCGGGCCGTACGGCACGCC
GACGGGCTGCTGGAGTACCGCGGACGGCTCGACCGCCAGGTCAAGCTGCGCGGCGCCCGC
ATCGAGCTGGACGAGGTGGAGACCCGCTTACGGGCCCACCCCGAGGTCGGCGAAGCGGCC
GTCGAGGTCGACGGGCACTCCCTGACCGCCTACGTCACGGCCACCGTCCCCGGCCGCCCG
CTGCCGCTGGCCGACCTGCGCGCGTACTGCGCCAAGTGGCTGCCCCCGCAGGCCGTCCCG
GCCCTGATACCCCTGGACCGCTTCCCGGTCACCAGCGGCGGCAAGATCGACCGCAGCCGT
CTGAAGCCGACCGCGCCACCGCCCGGCCCCGAAGACACCGCGGAGGCCGCGCGGCGCCCG
GACGAGCCGGAGGCCACCGACGGCCTGTCCGGTCTCCTCTCGGAAGTGTGGCACCAGGTG
CTGCGTGTCCGGCCCACGCCCCGGGACGACTTCTTCCTCCTCGGCGGCGACTCCCTGCTC
GCCTCGGAGACCGTCACCCGCACCCTCGCCGTACTCGGCCTCGACGCGGCCCTGGGCTCC
ACCCTCATCAGGGCGCTGCTGGCCGCGCCCACCCTCGAAAGCTTCACCGCCGCCGTACGC
GGAGTCCGCGGCGGCACCGGCGGACCGGCCGGCGGCCAGGAACCGGCCGTCGACTTCGCC

FIG. 4 (Cont.)

GCGGAGACCGGACTCGGCTTCGCCCTCCCGCCCGCCGAAGGCCCGGCGCCGAACCCGCAC
GACCCCGAGGACGTCCTGCTCACGGGCGCTTCCGGCTTCGTCGGCGGATTCCTGCTGCAC
CGTCTGCTGCACGCGACGGCCGCCCGCGTCCACTGCCCCGTACGGGCGACGAGCCCCGCC
CACGCCCGGCAGCGGGTCCGCACCGCCCTCACCCGCTACGGGCTGCACCTCGACGAGGCC
GACTGGCAGCGCGTGGAGTGCTTCCCCGGGGACCTGACCCAGCCGCGCCTGGGGCTCGAC
CACGAGCGCGCCGACGCACTGGCCCAGCGCCTGGACCTGATCGTGCACAACGGTGCCCGG
GTCAACTTCCTCTACCCCTACCAGCAGTTGCGCCCGGCGAACGTCGACGGAACCCGCGAG
GTCGTCCGGATCGCCGCGCGCCGCCGGGTGCCGGTGCACTTCGTGTCCACCGTCGCAGTC
GTCGCGGGCTTCGGCACCGCCGGGGTGCGCGAGGTGGACGAAGATCTGCCGCCGGCCCAC
GCCGACGGGCTGACCATGGGGTACGCGGAGAGCAAGTGGGTCGCCGAAGGGGTGCTGCGG
CAGGCGGCCGCGCAGGGCCTGCCGGTGGCCGTGTACCGGCCGTACGAGGTCACGGGCGAC
CGGACGCACGGCGCGTGCAACACCGAGACGGCCATCTGCTCGCTGTTCAAGATGATCGCC
GACACGGGAGTGGCCCCCGACATCAAGCTGCCGATGGACTTCGTACCCGTCGACCACCTC
GCCGAGTCCCTGGTGCACATCGCCACGCACCGGCCGGCCGACGGCCGGGTCTACCACCTG
ACCAACCCGCGCCCGGCGATGCTGTCGGACGTCCTCGACCGGATGCGCGCGGCGGGCTTC
ACCCTGCGCACCCTGCCGTACGACGCGTGGGTCGGCGAGCTCGTCCGGCACGTCGCCGAG
AACCCGACGAGCGCCACGGCTCCGTTCGTGTCCCTGTGCGTGGACCGCAGCCGCACCGCC
GACATGTCCGTCAAGGAGATGTACCTCAAGGGCACCTTCCCGGTCCTGGGGCGGCGCAAC
GCCGAGGAGGCGCTGGCCGGCAGCGGGCTGCACTGCCCGCCGGTCGACTCCGCTCTGCTG
GACCGCTACCTGGAGTACTTCTTCACCTCCGGCTACCTCACGCGCCCGGCGGCCGGCCCC
GGGCCCGAATCCGAGGCCGAGCGAATACCGGAGGACGAGCCGGTGTCCGGGACCGAACCG
ATATCCGGGACCGAACCGATTTCTGCCGCCGAGCCGATATCCGGGACCGAACCGATTTCT
GCCGCCGGGCCGATATCCGGGACCGAGCCGATACCCGCCGCCGAGCCGATATCCGGGACC
GCAGCCGCAGCCCGCACGGAGCGCAGCCGATGA

Amino acid sequence (SEQ ID NO:92)

>uniprot|Q2MFQ3|Q2MFQ3_STRRY Putative non-ribosomal peptide synthetase

MTDTYVSSRPLSKRPQVPGARTPAPGYPRDSRIPELFEAQAAALPQAPAARHGDRTLTYGQLDAHADALAD
RLAAGGVRPGDLIGVCGSRSLEALVALLGILKAGCAYVPLDEELPPARLRAMAEDAGISAAVTLPGSTRRV
RGLRVSVEVGSLGRPAPERASGPAPDRATGSAADCAYVAFTSGTTGRPKPVALSHRGVVRLVLSDPGLTPP
GPGDGVLHAYSLSSDASTIEIWGALLTGACLVVADREELLSPTALERLLRAGGVTVAYLTTSVFHLVARTR
PEALAGLRFVSAGGEAMDPRLANAVLAACPRTTVVNFYGPTENAVVSTAHVLTPLPEDAAHVPLGRPFGAS
TCHVLRADGSPARPGEEGELYVGGDGLALGYLGDPQLTAERFVTLPAVEPDGPLYRTGDRAVRHADGLLEY
RGRLDRQVKLRGARIELDEVETRLRAHPEVGEAAVEVDGHSLTAYVTATVPGRPLPLADLRAYCAKWLPPQ
AVPALIPLDRFPVTSGGKIDRSRLKPTAPPPGPEDTAEAARRPDEPEATDGLSGLLSEVWHQVLRVRPTPR
DDFFLLGGDSLLASETVTRTLAVLGLDAALGSTLIRALLAAPTLESFTAAVRGVRGGTGGPAGGQEPAVDF
AAETGLGFALPPAEGPAPNPHDPEDVLLTGASGFVGGFLLHRLLHATAARVHCPVRATSPAHARQRVRTAL
TRYGLHLDEADWQRVECFPGDLTQPRLGLDHERADALAQRLDLIVHNGARVNFLYPYQQLRPANVDGTREV
VRIAARRRVPVHFVSTVAVVAGFGTAGVREVDEDLPPAHADGLTMGYAESKWVAEGVLRQAAAQGLPVAVY
RPYEVTGDRTHGACNTETAICSLFKMIADTGVAPDIKLPMDFVPVDHLAESLVHIATHRPADGRVYHLTNP
RPAMLSDVLDRMRAAGFTLRTLPYDAWVGELVRHVAENPTSATAPFVSLCVDRSRTADMSVKEMYLKGTFP
VLGRRNAEEALAGSGLHCPPVDSALLDRYLEYFFTSGYLTRPAAGPGPESEAERIPEDEPVSGTEPISGTE
PISAAEPISGTEPISAAGPISGTEPIPAAEPISGTAAAARTERSR

Nucleotide sequence (SEQ ID NO:113)

>gi|189214978:54695-58201 Mycobacterium tuberculosis EAS054
NZ_ABOV01000087, whole genome shotgun sequence ATGTCGATCAACGATCAGCGACTGACACGCCGCGTCGAGGACCTATACGCCAGCGACGCCCAGTTCGCCG
CCGCCAGTCCCAACGAGGCGATCACCCAGGCGATCGACCAGCCCGGGGTCGCGCTTCCACAGCTCATCCG
TATGGTCATGGAGGGCTACGCCGATCGGCCGGCACTCGGCCAGCGTGCGCTCCGCTTCGTCACCGACCCC
GACAGCGGCCGCACCATGGTCGAGCTACTGCCGCGGTTCGAGACCATCACCTACCGCGAACTGTGGGCCC
GCGCCGGCACATTGGCCACCGCGTTGAGCGCTGAGCCCGCGATCCGGCCGGGCGACCGGGTTTGCGTGCT
GGGCTTCAACAGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACGATGATCGCCA
CCAGCATCGACAATCTTGGCGACGCCGTCGAAGTGCTGGCCGGTCACGCCCCGGCCCGGCTGGTCGTATT
CGATTACCACGGCAAGGTTGACACCCACCGCGAGGCCGTCGAAGCCGCCCGAGCTCGGTTGGCCGGCTCG
GTGACCATCGACACACTTGCCGAACTGATCGAACGCGGCAGGGCGCTGCCGGCCACACCCATTGCCGACA
GCGCCGACGACGCGCTGGCGCTGCTGACTTACACCTCGGGTAGTACCGGCGCACCCAAAGGCGCCATGTA
TCGCGAGAGCCAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACGCTTTCCAACG
GCGGTACCGCCTACTTCGTCGCCAAGAGCGACCTGTCGACGCTGTTCGAGGACCTCGCCCTGGTGCGGCC
CACAGAATTGTGCTTCGTGCCGCGCATCTGGGACATGGTGTTCGCAGAGTTCCACAGCGAGGTCGACCGC
CGCTTGGTGGACGGCGCCGATCGAGCGGCGCTGGAAGCGCAGGTGAAGGCCGAGCTGCGGGAGAACGTGC
TCGGCGGACGGTTTGTCATGGCGCTGACCGGTTCCGCGCCGATCTCCGCTGAGATGACGGCGTGGGTCGA
GTCCCTGCTGGCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGCTACTTCGGCA
CCGATCAGCCCTACCCCCGGGGCGAGCTGCTGGTCAAGACGCAAACCATGTTCCCCGGCTACTACCAGCG
CCCGGATGTCACCGCCGAGGTGTTCGACCCCGACGGCTTCTACCGGACCGGGGACATCATGGCCAAAGTA
GGCCCCGACCAGTTCGTCTACCTCGACCGCCGCAACAACGTGCTAAAGCTCTCCCAGGGCGAGTTCATCG
CCGTGTCGAAGCTCGAGGCGGTGTTCGGCGACAGCCCGCTGGTCCGACAGATCTTCATCTACGGCAACAG
TGCCCGGGCCTACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCCTACGAGATTC
CACGCGACTTCATCATCGAAACCACGCCGTTCACCCTGGAGAACGGCCTGCTCACCGGCATCCGCAAGCT
GGCACGCCCGCAGTTGAAGAAGTTCTATGGCGAACGTCTCGAGCGGCTCTATACCGAGCTGGCCGATAGC
CAATCCAACGAGCTGCGCGAGCTGCGGCAAAGCGGTCCCGATGCGCCGGTGCTTCCGACGCTGTGCCGTG
CCGCGGCTGCGTTGCTGGGCTCTACCGCTGCGGATGTGCGGCCGGACGCGCACTTCGCCGACCTGGGTGG
TGACTCGCTCTCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGCACCGGCGTCA
GGCGACCCAGCTTCGCCTCGATACACGGTCGCTCCGCGACGGAAGTGCACGCCAGCGACCTCACGCTGGA
CAAGTTCATCGACGCTGCCACCCTGGCCGCAGCCCCGAACCTGCCGGCACCGAGCGCCCAAGTGCGCACC
GTACTGCTGACCGGCGCCACCGGCTTTTTGGGTCGCTACCTGGCGCTGGAATGGCTCGACCGCATGGACC
TGGTCAACGGCAAGCTGATCTGCCTGGTCCGCGCCAGATCCGACGAGGAAGCACAAGCCCGGCTGGACGC
GACGTTCGATAGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTAGCCGACACGG
TGGACCTGATCGTGGACCCCGCGGCCCTGGTCAACCACGTGCTGCCGTATAGCCAGCTGTTCGGCCCAAA
CGCGGCGGGCACCGCCGAGTTGCTTCGGCTGGCGCTGACCGGCAAGCGCAAGCCATACATCTACACCTCG
ACGATCGCCGTGGGCGAGCAGATCCCGCCGGAGGCGTTCACCGAGGACGCCGACATCCGGGCCATCAGCC
CGACCCGCAGGATCGACGACAGCTACGCCAACGGCTACGCGAACAGCAAGTGGGCCGGCGAGGTGCTGCT
GCGCGAAGCTCACGAGCAGTGCGGCCTGCCGGTGACGGTCTTCCGCTGCGACATGATCCTGGCCGACACC
AGCTATACCGGTCAGCTCAACCTGCCGGACATGTTCACCCGGCTGATGCTGAGCCTGGCCGCTACCGGCA
TCGCACCCGGTTCGTTCTATGAGCTGGATGCGCACGGCAATCGGCAACGCGCCCACTATGACGGCTTGCC
GGTCGAATTCGTCGCAGAAGCCATTTGCACCCTTGGGACACATAGCCCGGACCGTTTTGTCACCTACCAC
GTGATGAACCCCTACGACGACGGCATCGGGCTGGACGAGTTCGTCGACTGGCTCAACTCCCCAACTAGCG

FIG. 4 (Cont.)

GGTCCGGTTGCACGATCCAGCGGATCGCCGACTACGGCGAGTGGCTGCAGCGGTTCGAGACTTCGCTGCG
TGCCTTGCCGGATCGCCAGCGCCACGCCTCGCTGCTGCCCTTGCTGCACAACTACCGAGAGCCTGCAAAG
CCGATATGCGGGTCAATCGCGCCCACCGACCAGTTCCGCGCTGCCGTCCAAGAAGCGAAAATCGGTCCGG
ACAAAGACATTCCGCACCTCACGGCGGCGATCATCGCGAAGTACATCAGCAACCTGCGACTGCTCGGGCT
GCTGTGA

Amino acid sequence (SEQ ID NO:114)

>gi|215431545|ref|ZP_03429464.1| fatty-acid-CoA ligase fadD9
[Mycobacterium tuberculosis EAS054]

MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLTYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILADT
SYTGQLNLPDMFTRLMLSLAATGIAPGSFYELDAHGNRQRAHYDGLPVEFVAEAICTLGTHSPDRFVTYH
VMNPYDDGIGLDEFVDWLNSPTSGSGCTIQRIADYGEWLQRFETSLRALPDRQRHASLLPLLHNYREPAK
PICGSIAPTDQFRAAVQEAKIGPDKDIPHLTAAIIAKYISNLRLLGLL

ZP_03533123

Nucleotide sequence (SEQ ID NO:115)

>gi|192384451:15291-18572 Mycobacterium tuberculosis GM 1503
NZ_ABQG01000169, whole genome shotgun sequence ATGGTCGAGCTACTGCCGCGGTTCGAGACCATCACCTACCGCGAACTGTGGGCCCGCGCCGGCACATTGG
CCACCGCGTTGAGCGCTGAGCCCGCGATCCGGCCGGGCGACCGGGTTTGCGTGCTGGGCTTCAACAGCGT
CGACTACACAACCATCGACATCGCGCTGATCCGGTTGGGCGCCGTGTCGGTTCCACTGCAGACCAGTGCG
CCGGTCACCGGGTTGCGCCCGATCGTCACCGAGACCGAGCCGACGATGATCGCCACCAGCATCGACAATC
TTGGCGACGCCGTCGAAGTGCTGGCCGGTCACGCCCCGGCCCGGCTGGTCGTATTCGATTACCACGGCAA
GGTTGACACCCACCGCGAGGCCGTCGAAGCCGCCCGAGCTCGGTTGGCCGGCTCGGTGACCATCGACACA
CTTGCCGAACTGATCGAACGCGGCAGGGCGCTGCCGGCCACACCCATTGCCGACAGCGCCGACGACGCGC
TGGCGCTGCTGATTTACACCTCGGGTAGTACCGGCGCACCCAAAGGCGCCATGTATCGCGAGAGCCAGGT
GATGAGCTTCTGGCGCAAGTCGAGTGGCTGGTTCGAGCCGAGCGGTTACCCCTCGATCACGCTGAACTTC
ATGCCGATGAGCCACGTCGGGGGCCGTCAGGTGCTCTACGGGACGCTTTCCAACGGCGGTACCGCCTACT
TCGTCGCCAAGAGCGACCTGTCGACGCTGTTCGAGGACCTCGCCCTGGTGCGGCCCACAGAATTGTGCTT
CGTGCCGCGCATCTGGGACATGGTGTTCGCAGAGTTCCACAGCGAGGTCGACCGCCGCTTGGTGGACGGC
GCCGATCGAGCGGCGCTGGAAGCGCAGGTGAAGGCCGAGCTGCGGGAGAACGTGCTCGGCGGACGGTTTG

FIG. 4 (Cont.)

TCATGGCGCTGACCGGTTCCGCGCCGATCTCCGCTGAGATGACGGCGTGGGTCGAGTCCCTGCTGGCCGA
CGTGCATTTGGTGGAGGGTTACGGCTCCACCGAGGCCGGGATGGTCCTGAACGACGGCATGGTGCGGCGC
CCCGCGGTGATCGACTACAAGCTGGTCGACGTGCCCGAGCTGGGCTACTTCGGCACCGATCAGCCCTACC
CCCGGGGCGAGCTGCTGGTCAAGACGCAAACCATGTTCCCCGGCTACTACCAGCGCCCGGATGTCACCGC
CGAGGTGTTCGACCCCGACGGCTTCTACCGGACCGGGGACATCATGGCCAAAGTAGGCCCCGACCAGTTC
GTCTACCTCGACCGCCGCAACAACGTGCTAAAGCTCTCCCAGGGCGAGTTCATCGCCGTGTCGAAGCTCG
AGGCGGTGTTCGGCGACAGCCCGCTGGTCCGACAGATCTTCATCTACGGCAACAGTGCCCGGGCCTACCC
GCTGGCGGTGGTTGTCCCGTCCGGGGACGCGCTTTCTCGCCATGGCATCGAGAATCTCAAGCCCGTGATC
AGCGAGTCCCTGCAGGAGGTAGCGAGGGCGGCCGGCCTGCAATCCTACGAGATTCCACGCGACTTCATCA
TCGAAACCACGCCGTTCACCCTGGAGAACGGCCTGCTCACCGGCATCCGCAAGCTGGCACGCCCGCAGTT
GAAGAAGTTCTATGGCGAACGTCTCGAGCGGCTCTATACCGAGCTGGCCGATAGCCAATCCAACGAGCTG
CGCGAGCTGCGGCAAAGCGGTCCCGATGCGCCGGTGCTTCCGACGCTGTGCCGTGCCGCGGCTGCGTTGC
TGGGCTCTACCGCTGCGGATGTGCGGCCGGACGCGCACTTCGCCGACCTGGGTGGTGACTCGCTCTCGGC
GCTGTCGTTGGCCAACCTGCTGCACGAGATCTTCGGCGTCGACGTGCCGGTGGGTGTCATTGTCAGCCCG
GCAAGCGACCTGCGGGCCCTGGCCGACCACATCGAAGCAGCGCGCACCGGCGTCAGGCGACCCAGCTTCG
CCTCGATACACGGTCGCTCCGCGACGGAAGTGCACGCCAGCGACCTCACGCTGGACAAGTTCATCGACGC
TGCCACCCTGGCCGCAGCCCCGAACCTGCCGGCACCGAGCGCCCAAGTGCGCACCGTACTGCTGACCGGC
GCCACCGGCTTTTTGGGTCGCTACCTGGCGCTGGAATGGCTCGACCGCATGGACCTGGTCAACGGCAAGC
TGATCTGCCTGGTCCGCGCCAGATCCGACGAGGAAGCACAAGCCCGGCTGGACGCGACGTTCGATAGCGG
CGACCCGTATTTGGTGCGGCACTACCGCGAATTGGGCGCCGGCCGCCTCGAGGTGCTCGCCGGCGACAAG
GGCGAGGCCGACCTGGGCCTGGACCGGGTCACCTGGCAGCGGCTAGCCGACACGGTGGACCTGATCGTGG
ACCCCGCGGCCCTGGTCAACCACGTGCTGCCGTATAGCCAGCTGTTCGGCCCAAACGCGGCGGGCACCGC
CGAGTTGCTTCGGCTGGCGCTGACCGGCAAGCGCAAGCCATACATCTACACCTCGACGATCGCCGTGGGC
GAGCAGATCCCGCCGGAGGCGTTCACCGAGGACGCCGACATCCGGGCCATCAGCCCGACCCGCAGGATCG
ACGACAGCTACGCCAACGGCTACGCGAACAGCAAGTGGGCCGGCGAGGTGCTGCTGCGCGAAGCTCACGA
GCAGTGCGGCCTGCCGGTGACGGTCTTCCGCTGCGACATGATCCTGGCCGACACCAGCTATACCGGTCAG
CTCAACCTGCCGGACATGTTCACCCGGCTGATGCTGAGCCTGGCCGCTACCGGCATCGCACCCGGTTCGT
TCTATGAGCTGGATGCGCACGGCAATCGGCAACGCGCCCACTATGACGGCTTGCCGGTCGAATTCGTCGC
AGAAGCCATTTGCACCCTTGGGACACATAGCCCGGACCGTTTTGTCACCTACCACGTGATGAACCCCTAC
GACGACGGCATCGGGCTGGACGAGTTCGTCGACTGGCTCAACTCCCCAACTAGCGGGTCCGGTTGCACGA
TCCAGCGGATCGCCGACTACGGCGAGTGGCTGCAGCGGTTCGAGACTTCGCTGCGTGCCTTGCCGGATCG
CCAGCGCCACGCCTCGCTGCTGCCCTTGCTGCACAACTACCGAGAGCCTGCAAAGCCGATATGCGGGTCA
ATCGCGCCCACCGACCAGTTCCGCGCTGCCGTCCAAGAAGCGAAAATCGGTCCGGACAAAGACATTCCGC
ACCTCACGGCGGCGATCATCGCGAAGTACATCAGCAACCTGCGACTGCTCGGGCTGCTGTGA

Amino acid sequence (SEQ ID NO:116)

>gi|218754327|ref|ZP_03533123.1| fatty-acid-CoA ligase fadD9
[Mycobacterium tuberculosis GM 1503]

MVELLPRFETITYRELWARAGTLATALSAEPAIRPGDRVCVLGFNSVDYTTIDIALIRLGAVSVPLQTSA
PVTGLRPIVTETEPTMIATSIDNLGDAVEVLAGHAPARLVVFDYHGKVDTHREAVEAARARLAGSVTIDT
LAELIERGRALPATPIADSADDALALLIYTSGSTGAPKGAMYRESQVMSFWRKSSGWFEPSGYPSITLNF
MPMSHVGGRQVLYGTLSNGGTAYFVAKSDLSTLFEDLALVRPTELCFVPRIWDMVFAEFHSEVDRRLVDG
ADRAALEAQVKAELRENVLGGRFVMALTGSAPISAEMTAWVESLLADVHLVEGYGSTEAGMVLNDGMVRR
PAVIDYKLVDVPELGYFGTDQPYPRGELLVKTQTMFPGYYQRPDVTAEVFDPDGFYRTGDIMAKVGPDQF
VYLDRRNNVLKLSQGEFIAVSKLEAVFGDSPLVRQIFIYGNSARAYPLAVVVPSGDALSRHGIENLKPVI
SESLQEVARAAGLQSYEIPRDFIIETTPFTLENGLLTGIRKLARPQLKKFYGERLERLYTELADSQSNEL
RELRQSGPDAPVLPTLCRAAAALLGSTAADVRPDAHFADLGGDSLSALSLANLLHEIFGVDVPVGVIVSP
ASDLRALADHIEAARTGVRRPSFASIHGRSATEVHASDLTLDKFIDAATLAAAPNLPAPSAQVRTVLLTG
ATGFLGRYLALEWLDRMDLVNGKLICLVRARSDEEAQARLDATFDSGDPYLVRHYRELGAGRLEVLAGDK

FIG. 4 (Cont.)

GEADLGLDRVTWQRLADTVDLIVDPAALVNHVLPYSQLFGPNAAGTAELLRLALTGKRKPYIYTSTIAVG
EQIPPEAFTEDADIRAISPTRRIDDSYANGYANSKWAGEVLLREAHEQCGLPVTVFRCDMILADTSYTGQ
LNLPDMFTRLMLSLAATGIAPGSFYELDAHGNRQRAHYDGLPVEFVAEAICTLGTHSPDRFVTYHVMNPY
DDGIGLDEFVDWLNSPTSGSGCTIQRIADYGEWLQRFETSLRALPDRQRHASLLPLLHNYREPAKPICGS
IAPTDQFRAAVQEAKIGPDKDIPHLTAAIIAKYISNLRLLGLL

ZP_03433592

Nucleotide sequence (SEQ ID NO:117)

>gi|189214744:1-3126 Mycobacterium tuberculosis T85 NZ_ABOW01000178,
whole genome shotgun sequence GACATCGCGCTGATCCGGTTGGGCGCCGTGTCGGTTCCACTGCAGACCAGTGCGCCGGTCACCGGGTTGC
GCCCGATCGTCACCGAGACCGAGCCGACGATGATCGCCACCAGCATCGACAATCTTGGCGACGCCGTCGA
AGTGCTGGCCGGTCACGCCCCGGCCCGGCTGGTCGTATTCGATTACCACGGCAAGGTTGACACCCACCGC
GAGGCCGTCGAAGCCGCCCGAGCTCGGTTGGCCGGCTCGGTGACCATCGACACACTTGCCGAACTGATCG
AACGCGGCAGGGCGCTGCCGGCCACACCCATTGCCGACAGCGCCGACGACGCGCTGGCGCTGCTGATTTA
CACCTCGGGTAGTACCGGCGCACCCAAAGGCGCCATGTATCGCGAGAGCCAGGTGATGAGCTTCTGGCGC
AAGTCGAGTGGCTGGTTCGAGCCGAGCGGTTACCCCTCGATCACGCTGAACTTCATGCCGATGAGCCACG
TCGGGGGCCGTCAGGTGCTCTACGGGACGCTTTCCAACGGCGGTACCGCCTACTTCGTCGCCAAGAGCGA
CCTGTCGACGCTGTTCGAGGACCTCGCCCTGGTGCGGCCCACAGAATTGTGCTTCGTGCCGCGCATCTGG
GACATGGTGTTCGCAGAGTTCCACAGCGAGGTCGACCGCCGCTTGGTGGACGGCGCCGATCGAGCGGCGC
TGGAAGCGCAGGTGAAGGCCGAGCTGCGGGAGAACGTGCTCGGCGGACGGTTTGTCATGGCGCTGACCGG
TTCCGCGCCGATCTCCGCTGAGATGACGGCGTGGGTCGAGTCCCTGCTGGCCGACGTGCATTTGGTGGAG
GGTTACGGCTCCACCGAGGCCGGGATGGTCCTGAACGACGGCATGGTGCGGCGCCCCGCGGTGATCGACT
ACAAGCTGGTCGACGTGCCCGAGCTGGGCTACTTCGGCACCGATCAGCCCTACCCCCGGGGCGAGCTGCT
GGTCAAGACGCAAACCATGTTCCCCGGCTACTACCAGCGCCCGGATGTCACCGCCGAGGTGTTCGACCCC
GACGGCTTCTACCGGACCGGGGACATCATGGCCAAAGTAGGCCCCGACCAGTTCGTCTACCTCGACCGCC
GCAACAACGTGCTAAAGCTCTCCCAGGGCGAGTTCATCGCCGTGTCGAAGCTCGAGGCGGTGTTCGGCGA
CAGCCCGCTGGTCCGACAGATCTTCATCTACGGCAACAGTGCCCGGGCCTACCCGCTGGCGGTGGTTGTC
CCGTCCGGGGACGCGCTTTCTCGCCATGGCATCGAGAATCTCAAGCCCGTGATCAGCGAGTCCCTGCAGG
AGGTAGCGAGGGCGGCCGGCCTGCAATCCTACGAGATTCCACGCGACTTCATCATCGAAACCACGCCGTT
CACCCTGGAGAACGGCCTGCTCACCGGCATCCGCAAGCTGGCACGCCCGCAGTTGAAGAAGTTCTATGGC
GAACGTCTCGAGCGGCTCTATACCGAGCTGGCCGATAGCCAATCCAACGAGCTGCGCGAGCTGCGGCAAA
GCGGTCCCGATGCGCCGGTGCTTCCGACGCTGTGCCGTGCCGCGGCTGCGTTGCTGGGCTCTACCGCTGC
GGATGTGCGGCCGGACGCGCACTTCGCCGACCTGGGTGGTGACTCGCTCTCGGCGCTGTCGTTGGCCAAC
CTGCTGCACGAGATCTTCGGCGTCGACGTGCCGGTGGGTGTCATTGTCAGCCCGGCAAGCGACCTGCGGG
CCCTGGCCGACCACATCGAAGCAGCGCGCACCGGCGTCAGGCGACCCAGCTTCGCCTCGATACACGGTCG
CTCCGCGACGGAAGTGCACGCCAGCGACCTCACGCTGGACAAGTTCATCGACGCTGCCACCCTGGCCGCA
GCCCCGAACCTGCCGGCACCGAGCGCCCAAGTGCGCACCGTACTGCTGACCGGCGCCACCGGCTTTTTGG
GTCGCTACCTGGCGCTGGAATGGCTCGACCGCATGGACCTGGTCAACGGCAAGCTGATCTGCCTGGTCCG
CGCCAGATCCGACGAGGAAGCACAAGCCCGGCTGGACGCGACGTTCGATAGCGGCGACCCGTATTTGGTG
CGGCACTACCGCGAATTGGGCGCCGGCCGCCTCGAGGTGCTCGCCGGCGACAAGGGCGAGGCCGACCTGG
GCCTGGACCGGGTCACCTGGCAGCGGCTAGCCGACACGGTGGACCTGATCGTGGACCCCGCGGCCCTGGT
CAACCACGTGCTGCCGTATAGCCAGCTGTTCGGCCCAAACGCGGCGGGCACCGCCGAGTTGCTTCGGCTG
GCGCTGACCGGCAAGCGCAAGCCATACATCTACACCTCGACGATCGCCGTGGGCGAGCAGATCCCGCCGG
AGGCGTTCACCGAGGACGCCGACATCCGGGCCATCAGCCCGACCCGCAGGATCGACGACAGCTACGCCAA
CGGCTACGCGAACAGCAAGTGGGCCGGCGAGGTGCTGCTGCGCGAAGCTCACGAGCAGTGCGGCCTGCCG
GTGACGGTCTTCCGCTGCGACATGATCCTGGCCGACACCAGCTATACCGGTCAGCTCAACCTGCCGGACA
TGTTCACCCGGCTGATGCTGAGCCTGGCCGCTACCGGCATCGCACCCGGTTCGTTCTATGAGCTGGATGC

FIG. 4 (Cont.)

GCACGGCAATCGGCAACGCGCCCACTATGACGGCTTGCCGGTCGAATTCGTCGCAGAAGCCATTTGCACC
CTTGGGACACATAGCCCGGACCGTTTTGTCACCTACCACGTGATGAACCCCTACGACGACGGCATCGGGC
TGGACGAGTTCGTCGACTGGCTCAACTCCCCAACTAGCGGGTCCGGTTGCACGATCCAGCGGATCGCCGA
CTACGGCGAGTGGCTGCAGCGGTTCGAGACTTCGCTGCGTGCCTTGCCGGATCGCCAGCGCCACGCCTCG
CTGCTGCCCTTGCTGCACAACTACCGAGAGCCTGCAAAGCCGATATGCGGGTCAATCGCGCCCACCGACC
AGTTCCGCGCTGCCGTCCAAGAAGCGAAAATCGGTCCGGACAAAGACATTCCGCACCTCACGGCGGCGAT
CATCGCGAAGTACATCAGCAACCTGCGACTGCTCGGGCTGCTGTGA

Amino acid sequence (SEQ ID NO:118)

>gi|215446840|ref|ZP_03433592.1| fatty-acid-CoA ligase fadD9
[Mycobacterium tuberculosis T85]

DIALIRLGAVSVPLQTSAPVTGLRPIVTETEPTMIATSIDNLGDAVEVLAGHAPARLVVFDYHGKVDTHR
EAVEAARARLAGSVTIDTLAELIERGRALPATPIADSADDALALLIYTSGSTGAPKGAMYRESQVMSFWR
KSSGWFEPSGYPSITLNFMPMSHVGGRQVLYGTLSNGGTAYFVAKSDLSTLFEDLALVRPTELCFVPRIW
DMVFAEFHSEVDRRLVDGADRAALEAQVKAELRENVLGGRFVMALTGSAPISAEMTAWVESLLADVHLVE
GYGSTEAGMVLNDGMVRRPAVIDYKLVDVPELGYFGTDQPYPRGELLVKTQTMFPGYYQRPDVTAEVFDP
DGFYRTGDIMAKVGPDQFVYLDRRNNVLKLSQGEFIAVSKLEAVFGDSPLVRQIFIYGNSARAYPLAVVV
PSGDALSRHGIENLKPVISESLQEVARAAGLQSYEIPRDFIIETTPFTLENGLLTGIRKLARPQLKKFYG
ERLERLYTELADSQSNELRELRQSGPDAPVLPTLCRAAAALLGSTAADVRPDAHFADLGGDSLSALSLAN
LLHEIFGVDVPVGVIVSPASDLRALADHIEAARTGVRRPSFASIHGRSATEVHASDLTLDKFIDAATLAA
APNLPAPSAQVRTVLLTGATGFLGRYLALEWLDRMDLVNGKLICLVRARSDEEAQARLDATFDSGDPYLV
RHYRELGAGRLEVLAGDKGEADLGLDRVTWQRLADTVDLIVDPAALVNHVLPYSQLFGPNAAGTAELLRL
ALTGKRKPYIYTSTIAVGEQIPPEAFTEDADIRAISPTRRIDDSYANGYANSKWAGEVLLREAHEQCGLP
VTVFRCDMILADTSYTGQLNLPDMFTRLMLSLAATGIAPGSFYELDAHGNRQRAHYDGLPVEFVAEAICT
LGTHSPDRFVTYHVMNPYDDGIGLDEFVDWLNSPTSGSGCTIQRIADYGEWLQRFETSLRALPDRQRHAS
LLPLLHNYREPAKPICGSIAPTDQFRAAVQEAKIGPDKDIPHLTAAIIAKYISNLRLLGLL

ZP_03537669

Nucleotide sequence (SEQ ID NO:119)

>gi|192384126:19547-22546 Mycobacterium tuberculosis T17
NZ_ABQH01000288, whole genome shotgun sequence ATGTCGATCAACGATCAGCGACTGACACGCCGCGTCGAGGACCTATACGCCAGCGACGCCCAGTTCGCCG
CCGCCAGTCCCAACGAGGCGATCACCCAGGCGATCGACCAGCCCGGGGTCGCGCTTCCACAGCTCATCCG
TATGGTCATGGAGGGCTACGCCGATCGGCCGGCACTCGGCCAGCGTGCGCTCCGCTTCGTCACCGACCCC
GACAGCGGCCGCACCATGGTCGAGCTACTGCCGCGGTTCGAGACCATCACCTACCGCGAACTGTGGGCCC
GCGCCGGCACATTGGCCACCGCGTTGAGCGCTGAGCCCGCGATCCGGCCGGGCGACCGGGTTTGCGTGCT
GGGCTTCAACAGCGTCGACTACACAACCATCGACATCGCGCTGATCCGGTTGGGCGCCGTGTCGGTTCCA
CTGCAGACCAGTGCGCCGGTCACCGGGTTGCGCCCGATCGTCACCGAGACCGAGCCGACGATGATCGCCA
CCAGCATCGACAATCTTGGCGACGCCGTCGAAGTGCTGGCCGGTCACGCCCCGGCCCGGCTGGTCGTATT
CGATTACCACGGCAAGGTTGACACCCACCGCGAGGCCGTCGAAGCCGCCCGAGCTCGGTTGGCCGGCTCG
GTGACCATCGACACACTTGCCGAACTGATCGAACGCGGCAGGGCGCTGCCGGCCACACCCATTGCCGACA
GCGCCGACGACGCGCTGGCGCTGCTGATTTACACCTCGGGTAGTACCGGCGCACCCAAAGGCGCCATGTA
TCGCGAGAGCCAGGTGATGAGCTTCTGGCGCAAGTCGAGTGGCTGGTTCGAGCCGAGCGGTTACCCCTCG
ATCACGCTGAACTTCATGCCGATGAGCCACGTCGGGGGCCGTCAGGTGCTCTACGGGACGCTTTCCAACG

FIG. 4 (Cont.)

GCGGTACCGCCTACTTCGTCGCCAAGAGCGACCTGTCGACGCTGTTCGAGGACCTCGCCCTGGTGCGGCC
CACAGAATTGTGCTTCGTGCCGCGCATCTGGGACATGGTGTTCGCAGAGTTCCACAGCGAGGTCGACCGC
CGCTTGGTGGACGGCGCCGATCGAGCGGCGCTGGAAGCGCAGGTGAAGGCCGAGCTGCGGGAGAACGTGC
TCGGCGGACGGTTTGTCATGGCGCTGACCGGTTCCGCGCCGATCTCCGCTGAGATGACGGCGTGGGTCGA
GTCCCTGCTGGCCGACGTGCATTTGGTGGAGGGTTACGGCTCCACCGAGGCCGGGATGGTCCTGAACGAC
GGCATGGTGCGGCGCCCCGCGGTGATCGACTACAAGCTGGTCGACGTGCCCGAGCTGGGCTACTTCGGCA
CCGATCAGCCCTACCCCCGGGGCGAGCTGCTGGTCAAGACGCAAACCATGTTCCCCGGCTACTACCAGCG
CCCGGATGTCACCGCCGAGGTGTTCGACCCCGACGGCTTCTACCGGACCGGGGACATCATGGCCAAAGTA
GGCCCCGACCAGTTCGTCTACCTCGACCGCCGCAACAACGTGCTAAAGCTCTCCCAGGGCGAGTTCATCG
CCGTGTCGAAGCTCGAGGCGGTGTTCGGCGACAGCCCGCTGGTCCGACAGATCTTCATCTACGGCAACAG
TGCCCGGGCCTACCCGCTGGCGGTGGTTGTCCCGTCCGGGGACGCGCTTTCTCGCCATGGCATCGAGAAT
CTCAAGCCCGTGATCAGCGAGTCCCTGCAGGAGGTAGCGAGGGCGGCCGGCCTGCAATCCTACGAGATTC
CACGCGACTTCATCATCGAAACCACGCCGTTCACCCTGGAGAACGGCCTGCTCACCGGCATCCGCAAGCT
GGCACGCCCGCAGTTGAAGAAGTTCTATGGCGAACGTCTCGAGCGGCTCTATACCGAGCTGGCCGATAGC
CAATCCAACGAGCTGCGCGAGCTGCGGCAAAGCGGTCCCGATGCGCCGGTGCTTCCGACGCTGTGCCGTG
CCGCGGCTGCGTTGCTGGGCTCTACCGCTGCGGATGTGCGGCCGGACGCGCACTTCGCCGACCTGGGTGG
TGACTCGCTCTCGGCGCTGTCGTTGGCCAACCTGCTGCACGAGATCTTCGGCGTCGACGTGCCGGTGGGT
GTCATTGTCAGCCCGGCAAGCGACCTGCGGGCCCTGGCCGACCACATCGAAGCAGCGCGCACCGGCGTCA
GGCGACCCAGCTTCGCCTCGATACACGGTCGCTCCGCGACGGAAGTGCACGCCAGCGACCTCACGCTGGA
CAAGTTCATCGACGCTGCCACCCTGGCCGCAGCCCCGAACCTGCCGGCACCGAGCGCCCAAGTGCGCACC
GTACTGCTGACCGGCGCCACCGGCTTTTTGGGTCGCTACCTGGCGCTGGAATGGCTCGACCGCATGGACC
TGGTCAACGGCAAGCTGATCTGCCTGGTCCGCGCCAGATCCGACGAGGAAGCACAAGCCCGGCTGGACGC
GACGTTCGATAGCGGCGACCCGTATTTGGTGCGGCACTACCGCGAATTGGGCGCCGGCCGCCTCGAGGTG
CTCGCCGGCGACAAGGGCGAGGCCGACCTGGGCCTGGACCGGGTCACCTGGCAGCGGCTAGCCGACACGG
TGGACCTGATCGTGGACCCCGCGGCCCTGGTCAACCACGTGCTGCCGTATAGCCAGCTGTTCGGCCCAAA
CGCGGCGGGCACCGCCGAGTTGCTTCGGCTGGCGCTGACCGGCAAGCGCAAGCCATACATCTACACCTCG
ACGATCGCCGTGGGCGAGCAGATCCCGCCGGAGGCGTTCACCGAGGACGCCGACATCCGGGCCATCAGCC
CGACCCGCAGGATCGACGACAGCTACGCCAACGGCTACGCGAACAGCAAGTGGGCCGGCGAGGTGCTGCT
GCGCGAAGCTCACGAGCAGTGCGGCCTGCCGGTGACGGTCTTCCGCTGCGACATGATCCTGGGCCGACAC
CAGCTATACCGGTCAGCTCAACCTGCCGGACATGTCACCCGGGCTGATGCTGAGCCTGGC

Amino acid sequence (SEQ ID NO:120)

>gi|219558593|ref|ZP_03537669.1| fatty-acid-CoA ligase fadD9
[Mycobacterium tuberculosis T17]

MSINDQRLTRRVEDLYASDAQFAAASPNEAITQAIDQPGVALPQLIRMVMEGYADRPALGQRALRFVTDP
DSGRTMVELLPRFETITYRELWARAGTLATALSAEPAIRPGDRVCVLGFNSVDYTTIDIALIRLGAVSVP
LQTSAPVTGLRPIVTETEPTMIATSIDNLGDAVEVLAGHAPARLVVFDYHGKVDTHREAVEAARARLAGS
VTIDTLAELIERGRALPATPIADSADDALALLIYTSGSTGAPKGAMYRESQVMSFWRKSSGWFEPSGYPS
ITLNFMPMSHVGGRQVLYGTLSNGGTAYFVAKSDLSTLFEDLALVRPTELCFVPRIWDMVFAEFHSEVDR
RLVDGADRAALEAQVKAELRENVLGGRFVMALTGSAPISAEMTAWVESLLADVHLVEGYGSTEAGMVLND
GMVRRPAVIDYKLVDVPELGYFGTDQPYPRGELLVKTQTMFPGYYQRPDVTAEVFDPDGFYRTGDIMAKV
GPDQFVYLDRRNNVLKLSQGEFIAVSKLEAVFGDSPLVRQIFIYGNSARAYPLAVVVPSGDALSRHGIEN
LKPVISESLQEVARAAGLQSYEIPRDFIIETTPFTLENGLLTGIRKLARPQLKKFYGERLERLYTELADS
QSNELRELRQSGPDAPVLPTLCRAAAALLGSTAADVRPDAHFADLGGDSLSALSLANLLHEIFGVDVPVG
VIVSPASDLRALADHIEAARTGVRRPSFASIHGRSATEVHASDLTLDKFIDAATLAAAPNLPAPSAQVRT
VLLTGATGFLGRYLALEWLDRMDLVNGKLICLVRARSDEEAQARLDATFDSGDPYLVRHYRELGAGRLEV
LAGDKGEADLGLDRVTWQRLADTVDLIVDPAALVNHVLPYSQLFGPNAAGTAELLRLALTGKRKPYIYTS
TIAVGEQIPPEAFTEDADIRAISPTRRIDDSYANGYANSKWAGEVLLREAHEQCGLPVTVFRCDMILGRH
QLYRSAQPAGHVTRADAEPG

Nucleotide sequence (SEQ ID NO:121)

>gi|163719654:2489-6013 Mycobacterium intracellulare ATCC 13950
NZ_ABIN01000072, whole genome shotgun sequence ATGTCGACTGCCATTCATGACGAACACCTCGACCGTCGCATCGAGGAACTCATCGCCAACGACCCCCAAT
TCGCCGCCGCCCGACCGGACCCGGCCATCACCGCCGCCACCGAAGCGCCCGGGCTGCGGCTGCCGCAGAT
CATCCGGACCGTGCTCGACGGCTACGCCGACCGGCCTGCCCTGGCGCAGCGCGTCGTGGAGTTCGTCACC
GACGCCAAGACCGGGCGGACGACGGCCGAGCTGCTCCCCCGTTTCGAGACCATCACGTATGGCGAACTCG
GCGAACGGGTTTCGGCCCTCGGCCGTGCCTGGGCCGGCGACGCGGTGCGCCCCGGCGACCGCGTCTGCGT
GCTCGGCTTCAACAGCGTTGACTACGCCACCATCGACATCGCGCTGGGCACCATCGGGGCCGTGTCGGTG
CCGCTGCAGACCAGCGCGGCGATCTCCTCGTTGCAGCCGATCGTCGCCGAGACCGAGCCCAGCCTGATCG
CCTCGAGCGTCAACCAGCTGCCCGACGCGGTGGAGCTGATCCTGGCCGGCGACCACGTGCCCGGCAAGCT
CGTCGTGTTCGACTACCAGCCCCAGGTCGACGACCAGCGCGAGGCCGTGGAGGCCGCCGCCGCGCGGTTG
GCCGACTCCGGCGTCGCGGTCGAGGCTCTCGCCGACGTGCTGCGGCGCGGCAAGGACCTGCCGGCCGTCG
AGCCGCCGGCGAGCGACGAGGACTCGCTGGCCCTGCTGATCTACACCTCCGGCAGCACCGGCGCGCCCAA
GGGCGCGATGTACCCGCAGAGCAACGTCGGCAAGATGTGGCGGCGCGGGAGCAAGAACTGGTTCGGGGAA
AGCGCCGCGTCGATCACCCTCAACTTCATGCCGATGAGCCACGTCATGGGGCGCGGAATCCTCTACGGCA
CGCTGGGCAACGGCGGCACCGCGTACTTCGCCGCCCGCAGCGACCTGTCCACCCTGCTCGAGGACCTCGA
GTTGGTGCGGCCCACCGAGATGAACTTCGTCCCCCGCATCTGGGAGACGCTGTACGGCGAATTCCAGCGC
CAGGTCGAGCGGCGGCTGGCCGACGGCGATGCGGGCCCGGAGGCCCGCGAGACTGTGGCGGCTGCGGTGT
TGGAAGAACAGCGCCAGTACCTGCTGGGCGGGCGGTTCATCTTCGCGATGACGGGCTCGGCACCCACCTC
GCCGGAGCTCAAGGCGTGGGCCGAGTCGCTCCTGCAGATGCACCTGATGGACGGCTACGGCTCCACCGAG
GCCGGAATGGTGTTGTTCGACGGGGAGATTCAGCGTCCGCCGGTTATTGATTACAAGCTGGTCGACGTTC
CGGATCTGGGCTATTTCAGCACCGACCGTCCGCATCCGCGCGGTGAGTTGTTGCTGCGGACCGAGAACAT
GTTCCCGGGTTATTACAAGCGGGCCGAGACCACCGCGAACGTGTTCGACGAGGACGGTTATTACCGCACC
GGTGACGTGTTCGCCGAGATCGCGCCGGACCGGCTGGTGTATGTCGATCGCCGCAACAACGTGCTCAAGT
TGGCCCAGGGCGAGTTCGTGACGCTGGCCAAGCTGGAGGCGGTGTTCGGCAACAGCCCGCTGATCCGCCA
GATCTACGTTTACGGCAACAGCTCCCAGCCCTACCTGCTGGCCGTGGTGGTGCCGACCGAGGAAGCGTTG
GCGGACAACGATCTTGAGTCGCTCAAGCCGAAGATCGCCGACTCGCTGCAGAAGGTCGCCAAGGAGACCG
GCCTGCAGTCCTACGAGGTGCCGCGCGACTTCATCATCGAGACCACGCCGTTCACCCTGGAAAACGGCCT
GCTGACCGGGATCCGCAAGCTGGCGTGGCCCAAGCTCAAGGCGCACTACGGGGATCGGCTCGAGCAGATG
TATGCCGAGCTGGCCGCGGGACAGGCCAACGAGTTGGCCGAACTGCGCCGCAGCGGCGCGGCGGCGCCGG
TGGCCCAGACCGTGAGCCGGGCCGCGGCCGCCCTGCTGGGTGCGACGGCCGGGGATCTGTCCGCAGATGC
CCACTTCACCGATCTTGGTGGAGACTCGTTGTCGGCGTTGACCTTCGGCAACCTGCTGCGCGAGATCTTC
GATGTCGACGTGCCGGTGGGGGTGATCGTCAGCCCGGCCAACGACCTGGCGGGGATCGCCGCCTACATCG
AGGCCGAGCGGCAGGGCTCCAAGCGCCCGACGTTCGCCGCCGTGCACGGTCGCGGTGCGACCATGGTGCA
CGCCAGTGACCTCACGCTGGACAAGTTCCTCGACGAGGCGACCCTGGCCGCCGCGCCCAGCCTGCCCAAG
CCGGCCACCGAGGTGCGCACCGTGCTGTTGACCGGCGCGACCGGCTTTTTGGGCCGCTACCTGGCGCTGG
ACTGGCTCGAGCGGATGGACATGGTCGACGGCAAGGTCATCGCCCTGGTGCGGGCCCGCACCGATGAGGA
GGCGCGCGCCCGGCTGGACAAGACCTTCGACAGCGGCGACCCCAAACTGCTGGCGCACTACCAGCGGCTG
GCCGCCGACCACCTCGAGGTCATCGCCGGCGACAAGGGTGAGGCCAACCTCGGCCTGGACCCCCAGACCT
GGCAGCGACTGGCCGAGGAGGTCGACGTCATCGTCGACCCCGCCGCGCTGGTCAACCACGTGCTGCCCTA
CAGCGAGCTGTTCGGCCCCAACGCCCTGGGCACCGCGGAGCTGATCCGGATCGCGCTGACCTCCAGGCAA
AAGCCCTACACCTACGTGTCGACGATCGGGGTGGGCGATCAGATCCAGCCAGGTGAGTTCGTCGAGAACG
CCGACATCCGCCAGATCAGCGCCACCCGCGAGATCAACGACGGCTACGCCAACGGCTACGGCAACAGCAA
GTGGGCCGGCGAGGTGTTGCTGCGCGAGGCCCACGACCTGTGCGGCCTGCCCGTCACGGTGTTCCGCTGC
GACATGATCCTGGCCGACACCACCTATGCCGGGCAGCTCAACCTGCCCGACATGTTCACCCGGCTGATGC

FIG. 4 (Cont.)

TGAGCCTGGTCGCCACCGGTATCGCGCCCGGGTCGTTCTACGAACTGGACGCCGACGGCAACCGCCAGCG
GGCACACTACGACGGTTTGCCGGTCGAGTTCATCGCCGCGGCGATCTCGACGCTGGGGACCCAAATCACC
GACAGCGACACGGGCTTTCAGACCTACCACGTGATGAACCCCTACGACGACGGCATCGGGCTGGATGAGT
ACATCGATTGGCTGATCGAGGCCGGGTATTCGATCGAGCGGATCGCCGATTACTCCGAGTGGCTGCGGCG
CTTCGAGACCTCGCTGCGGGCCCTGCCCGATCGGCAGCGTCAGTACTCGCTGCTGCCGCTGCTGCACAAC
TACCAGAAGCCGGAAAAGCCGATCAACGGCTCGATGGCGCCCACCGACGTGTTCCGTGCCGCGGTGCAGG
AAGCGAAAATCGGCCCCGACAAAGACATCCCGCACGTCTCGGCGCCGGTGATCGTCAAGTACATCACCGA
CCTGGAGTTGCTCGGACTCCTCTGA

Amino acid sequence (SEQ ID NO:122)

>gi|254819907|ref|ZP_05224908.1| FadD9 [Mycobacterium intracellulare ATCC 13950]

MSTAIHDEHLDRRIEELIANDPQFAAARPDPAITAATEAPGLRLPQIIRTVLDGYADRPALAQRVVEFVT
DAKTGRTTAELLPRFETITYGELGERVSALGRAWAGDAVRPGDRVCVLGFNSVDYATIDIALGTIGAVSV
PLQTSAAISSLQPIVAETEPSLIASSVNQLPDAVELILAGDHVPGKLVVFDYQPQVDDQREAVEAAAARL
ADSGVAVEALADVLRRGKDLPAVEPPASDEDSLALLIYTSGSTGAPKGAMYPQSNVGKMWRRGSKNWFGE
SAASITLNFMPMSHVMGRGILYGTLGNGGTAYFAARSDLSTLLEDLELVRPTEMNFVPRIWETLYGEFQR
QVERRLADGDAGPEARETVAAAVLEEQRQYLLGGRFIFAMTGSAPTSPELKAWAESLLQMHLMDGYGSTE
AGMVLFDGEIQRPPVIDYKLVDVPDLGYFSTDRPHPRGELLLRTENMFPGYYKRAETTANVFDEDGYYRT
GDVFAEIAPDRLVYVDRRNNVLKLAQGEFVTLAKLEAVFGNSPLIRQIYVYGNSSQPYLLAVVVPTEEAL
ADNDLESLKPKIADSLQKVAKETGLQSYEVPRDFIIETTPFTLENGLLTGIRKLAWPKLKAHYGDRLEQM
YAELAAGQANELAELRRSGAAAPVAQTVSRAAAALLGATAGDLSADAHFTDLGGDSLSALTFGNLLREIF
DVDVPVGVIVSPANDLAGIAAYIEAERQGSKRPTFAAVHGRGATMVHASDLTLDKFLDEATLAAAPSLPK
PATEVRTVLLTGATGFLGRYLALDWLERMDMVDGKVIALVRARTDEEARARLDKTFDSGDPKLLAHYQRL
AADHLEVIAGDKGEANLGLDPQTWQRLAEEVDVIVDPAALVNHVLPYSELFGPNALGTAELIRIALTSRQ
KPYTYVSTIGVGDQIQPGEFVENADIRQISATREINDGYANGYGNSKWAGEVLLREAHDLCGLPVTVFRC
DMILADTTYAGQLNLPDMFTRLMLSLVATGIAPGSFYELDADGNRQRAHYDGLPVEFIAAAISTLGTQIT
DSDTGFQTYHVMNPYDDGIGLDEYIDWLIEAGYSIERIADYSEWLRRFETSLRALPDRQRQYSLLPLLHN
YQKPEKPINGSMAPTDVFRAAVQEAKIGPDKDIPHVSAPVIVKYITDLELLGLL

FIG. 5

*Accession Numbers are from NCBI, GenBank, Release 159.0 as of March 2008*
*EC Numbers are from KEGG, Release 42.0 as of April 2007 (plus daily updates up to March 2008)*

| CATEGORY | GENE | NAME | ACCESSION | EC NUMBER | MODIFICATION | USE | ORGANISM |
|---|---|---|---|---|---|---|---|
| | | | | | | | |
| 1. Fatty Acid Production Increase / Product Production Increase | | | | | | | |
| | | | | | | | |
| *increase acyl-CoA* | | | | | | | |
| *reduce catabolism of derivatives and intermediates* | | | | | | | |
| *reduce feedback inhibition* | | | | | | | |
| *attenuate other pathways that consume fatty acids* | | | | | | | |
| | | | | | | | |
| | accA | Acetyl-CoA carboxylase, subunit A (carboxyltransferase alpha) | AAC73296, NP_414727 | 6.4.1.2 | Over-express | increase Malonyl-CoA production | *Escherichia coli, Lactococci* |
| | accB | Acetyl-CoA carboxylase, subunit B (BCCP: biotin carboxyl carrier protein) | NP_417721 | 6.4.1.2 | Over-express | increase Malonyl-CoA production | *Escherichia coli, Lactococci* |
| | accC | Acetyl-CoA carboxylase, subunit C (biotin carboxylase) | NP_417722 | 6.4.1.2, 6.3.4.14 | Over-express | increase Malonyl-CoA production | *Escherichia coli, Lactococci* |
| | accD | Acetyl-CoA carboxylase, subunit D (carboxyltransferase beta) | NP_416819 | 6.4.1.2 | Over-express | increase Malonyl-CoA production | *Escherichia coli, Lactococci* |
| | aceE | pyruvate dehydrogenase, subunit E1 | NP_414656, AAC73226 | 1.2.4.1 | Over-express | increase Acetyl-CoA production | *Escherichia coli* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | aceF | pyruvate dehydrogenase, subunit E2 | NP_414657 | 2.3.1.12 | Over-express | increase Acetyl-CoA production | *Escherichia coli* |
| | ackA | acetate kinase | AAC75356, NP_416799 | 2.7.2.1 | Delete or reduce | increase Acetyl-CoA production | *Escherichia coli* |
| | ackB | acetate kinase AckB | BAB81430 | 2.7.2.1 | Delete or reduce | increase Acetyl-CoA production | *Escherichia coli* |
| | acpP | acyl carrier protein | AAC74178 | NONE | Over-express | increase Acetyl-CoA production | *Escherichia coli* |
| | fadD | acyl-CoA synthase | AP_002424 | 2.3.1.86, 6.2.1.3 | Over-express | increase Fatty acid production | *Escherichia coli W3110* |
| | adhE | alcohol dehydrogenase | CAA47743 | 1.1.1.1, 1.2.1.10 | Delete or reduce | increase Acetyl-CoA production | *Escherichia coli W3111* |
| | cer1 | Aldehyde decarbonylase | BAA11024 | 4.1.99.5 | Over-express | increase Acetyl-CoA production | *Arabidopsis thaliana* |
| | fabA | beta-hydroxydecanoyl thioester dehydrase | NP_415474 | 4.2.1.60 | express | fatty acyl-CoA production | *E. coli K12* |
| | fabD | [acyl-carrier-protein] S-malonyltransferase | AAC74176 | 2.3.1.39 | Over-express | increase Acetyl-CoA production | *E. coli K12* |
| | fabF | 3-oxoacyl-[acyl-carrier-protein] synthase II | AAC74179 | 2.3.1.179 | Delete or OverExpress | increase Acetyl-CoA production | *E. coli K12* |
| | fabG | 3-oxoacyl-[acyl-carrier protein] reductase | AAC74177 | 1.1.1.100 | Over-express | increase Acetyl-CoA production | *E. coli K12* |
| | fabH | 3-oxoacyl-[acyl-carrier-protein] synthase III | AAC74175 | 2.3.1.180 | Over-express | increase Acetyl-CoA production | *E. coli K12, lactococci* |
| | fabI | enoyl-[acyl-carrier-protein] reductase, NADH-dependent | NP_415804 | 1.3.1.9 | express | fatty acyl-CoA production | *E. coli K12, lactococci* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | fabR | Transcriptional Repressor | NP_418398 | NONE | Delete or reduce | modulate unsaturated fatty acid production | *E. coli K12* |
| | fabZ | (3R)-hydroxymyristol acyl carrier protein dehydratase | NP_414722 | 4.2.1.- | | | *E. coli K12* |
| | fadE | acyl-CoA dehydrogenase | AAC73325 | 1.3.99.3, 1.3.99.- | Delete or reduce | increase Acetyl-CoA production | |
| | acr1 | Fatty Acyl-CoA reductase | YP_047869, AAC45217 | 1.2.1.42 | Over-express | for fatty alcohol production | *Acinetobacter sp., i.e. calcoaceticus* |
| | GST, gshB | Glutathione synthase | P04425 | 6.3.2.3 | Delete or reduce | increase Acyl-CoA | *E. coli K12* |
| | gpsA | biosynthetic sn-glycerol 3-phosphate dehydrogenase | AAC76632, NP_418065 | EC: 1.1.1.94 | Delete or reduce | increase Acetyl-CoA production | *E. coli K12* |
| | ldhA | lactate dehydrogenase | AAC74462, NP_415898 | EC: 1.1.1.27, 1.1.1.28 | Delete or reduce | increase Acetyl-CoA production | *E. coli K12* |
| | Lipase | Triglyceride Lipase | CAA89087, CAA98876 | 3.1.1.3 | express | increase Fatty acid production | *Saccharomyces cerevisiae* |
| | | Malonyl-CoA decarboxylase | AAA26500 | 4.1.1.9, 4.1.1.41 | Over-express | | *Saccharopolyspora erythraea* |
| | panD | aspartate 1-decarboxylase | BAB96708 | 4.1.1.11 | Over-express | increase Acyl-CoA | *Escherichia coli W3110* |
| | panK a.k.a. coaA | pantothenate kinase | AAC76952 | 2.7.1.33 | Over-express | increase Acetyl-CoA production | *E. coli* |
| | panK a.k.a. coaA, R106K | pantothenate kinase | AAC76952 | 2.7.1.33 | Express, Over-express, R106K mutation | increase Acetyl-CoA production | *E. coli* |
| | pdh | Pyruvate dehydrogenase | BAB34380, AAC73226, NP_415392 | 1.2.4.1 | Over-express | increase Acetyl-CoA production | |
| | pflB | formate acetyltransferase (pyruvate formate lyase) | AAC73989, P09373 | EC: 2.3.1.54 | Delete or reduce | increase Acetyl-CoA production | |
| | plsB | acyltransferase | AAC77011 | 2.3.1.15 | D311E mutation | reduce limits on Acyl-CoA pool | *E. coli K12* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | poxB | pyruvate oxidase | AAC73958, NP_415392 | 1.2.2.2 | Delete or reduce | increase Acetyl-CoA production | |
| | pta | phosphotransacetylase | AAC75357, NP_416800 | 2.3.1.8 | Delete or reduce | increase Acetyl-CoA production | |
| | udhA | pyridine nucleotide transhydrogenase | CAA46822 | 1.6.1.1 | Over-express | conversion NADH to NADPH or vice versa | |
| | fadB | fused 3-hydroxybutyryl-CoA epimerase/delta(3)-cis-delta(2)-trans-enoyl-CoA isomerase/enoyl-CoA hydratase and 3-hydroxyacyl-CoA dehydrogenase | AP_003956 | 4.2.1.17, 5.1.2.3, 5.3.3.8, 1.1.1.35 | Delete or reduce | Block fatty acid degradation | *E. coli* |
| | fadJ | 3-hydroxyacyl-CoA dehydrogenase: K01692 enoyl-CoA hydratase; K01782 3-hydroxybutyryl-CoA epimerase | AAC75401 | 1.1.1.35, 4.2.1.17, 5.1.2.3 | Delete or reduce | Block fatty acid degradation | *E. coli* |
| | fadA | 3-ketoacyl-CoA thiolase | BAE77458 | 2.3.1.16 | Delete or reduce | Block fatty acid degradation | *E. coli* |
| | fadI | beta-ketoacyl-CoA thiolase | AAC75402 | 2.3.1.16 | Delete or reduce | Block fatty acid degradation | *E. coli* |
| | YdiO | acyl-coA dehydrogenase | YP_852786 | 1.3.99.- | Delete or reduce | Block fatty acid degradation | *E. coli* |
| | | | | | | | |
| 2. Structure Control | | | | | | | |
| | | | | | | | |
| 2A. Chain Length Control | | | | | | | |
| 2 | tesA | thioesterase | P0ADA1 | 3.1.2.-, 3.1.1.5 | Delete and/or express | C18 Chain Length | |
| | tesA without leader sequence | thioesterase | AAC73596, NP_415027 | 3.1.2.-, 3.1.1.5 | express or overexpress | C18:1 | *E.coli* |
| | tesA without leader | thioesterase | P0ADA1 | 3.1.2.-, 3.1.1.5 | Express and/or overexpress | <C18 Chain Length | *E. coli* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | sequence:L109P | | | | mutation L109P | | |
| | fatB1 (umbellularia) | thioesterase | Q41635 | 3.1.2.14 | express or overexpress | C12:0 | *Umbellularia californica* |
| | fatB2 (umbellularia)DELETE umbelluria) | thioesterase | AAC49269 | 3.1.2.14 | express or overexpress | C8:0 - C10:0 | *Cuphea hookeriana* |
| | fatB3 | thioesterase | AAC72881 | 3.1.2.14 | express or overexpress | C14:0 - C16:0 | *Cuphea hookeriana* |
| | fatB (cinnamonum) | thioesterase | Q39473 | 3.1.2.14 | express or overexpress | C14:0 | *Cinnamomum camphora* |
| | fatB[M141T]* | thioesterase | CAA85388 | 3.1.2.14 | express or overexpress | C16:1 | *Arabidopsis thaliana* |
| | fatA1 (Helianthus) | thioesterase | AAL79361 | 3.1.2.14 | express or overexpress | *C18:1* | *Helianthus annuus* |
| | atfata (ARABIDOPSIS FATA ACYL-ACP THIOESTERASE) | thioesterase | NP_189147, NP_193041 | 3.1.2.14 | express or overexpress | C18:1 | *Arabidopsis thaliana* |
| | fatA | thioesterase | CAC39106 | 3.1.2.14 | express or overexpress | C18:1 | *Brassica juncea* |
| | fatA (cuphea) | thioesterase | AAC72883 | 3.1.2.14 | express or overexpress | C18:1 | *Cuphea hookeriana* |
| | | | | | | | |
| 2B. Branching Control | | | | | | | |
| | *attenuate FabH* | | | | | | |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | *express FabH from S. glaucescens or S. coelicolor and knock out endogenouse FabH* | | | | | increase branched chain fatty acid derivatives | |
| | *express FabH from B. subtilis and knock out endogenouse FabH* | | | | | | |
| | *bdk - E3 - dihydroplipoyl dehyrodgenase subunit* | | | EC 1.2.4.4 | | | |
| | *bkd - E1- alpha/beta subunit* | decarboxylase subunits of branched-chain α-keto acid dehydrogenase complex | | EC 1.2.4.4 | | | |
| | *bkd - E2 - dihydrolipoyl transacylase subunit* | | | EC 1.2.4.4 | | | |
| | bkdA1 | branched-chain α-keto acid dehydrogenase a-subunit (E1a) | NP_628006 | EC 1.2.4.4 | express or Over-Express | make branched-chain acyl-CoA precursors | *Streptomyces coelicolor* |
| | bkdB1 | branched-chain α-keto acid dehydrogenase a-subunit (E1b) | NP_628005 | EC 1.2.4.4 | express or Over-Express | make branched-chain acyl-CoA precursors | *Streptomyces coelicolor* |
| | bkdC1 | dihydrolipoyl transacetylase (E2) | NP_628004 | EC 2.3.1.168 | express or Over-Express | make branched-chain acyl-CoA precursors | *Streptomyces coelicolor* |
| | bkdA2 | branched-chain a-ketoacid dehydrogenase a-subunit (E1a) | NP_733618 | EC 1.2.4.4 | express or Over-Express | make branched-chain acyl-CoA precursors | *Streptomyces coelicolor* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | bkdB2 | branched-chain a-ketoacid dehydrogenase b-subunit (E1b) | NP_628019 | EC 1.2.4.4 | express or Over-Express | make branched-chain acyl-CoA precursors | *Streptomyces coelicolor* |
| | bkdC2 | dihydrolipoyl transacetylase (E2) | NP_628018 | EC 2.3.1.168 | express or Over-Express | make branched-chain acyl-CoA precursors | *Streptomyces coelicolor* |
| | bkdA | branched-chain a-ketoacid dehydrogenase a-subunit (E1a) | BAC72074 | EC 1.2.4.4 | express or Over-Express | make branched-chain acyl-CoA precursors | *Streptomyces avermitilis* |
| | bkdB | branched-chain a-ketoacid dehydrogenase b-subunit (E1b) | BAC72075 | EC 1.2.4.4 | express or Over-Express | make branched-chain acyl-CoA precursors | *Streptomyces avermitilis* |
| | bkdC | dihydrolipoyl transacetylase (E2) | BAC72076 | EC 2.3.1.168 | express or Over-Express | make branched-chain acyl-CoA precursors | *Streptomyces avermitilis* |
| | bkdF | branched-chain a-ketoacid dehydrogenase a-subunit (E1a) | BAC72088 | EC 1.2.4.4 | express or Over-Express | make branched-chain acyl-CoA precursors | *Streptomyces avermitilis* |
| | bkdG | branched-chain a-ketoacid dehydrogenase b-subunit (E1b) | BAC72089 | EC 1.2.4.4 | express or Over-Express | make branched-chain acyl-CoA precursors | *Streptomyces avermitilis* |
| | bkdH | dihydrolipoyl transacetylase (E2) | BAC72090 | EC 2.3.1.168 | express or Over-Express | make branched-chain acyl-CoA precursors | *Streptomyces avermitilis* |
| | bkdAA | branched-chain a-ketoacid dehydrogenase a-subunit (E1a) | NP_390285 | EC 1.2.4.4 | express or Over-Express | make branched-chain acyl-CoA precursors | *Bacillus subtilis* |
| | bkdAB | branched-chain a-ketoacid dehydrogenase b-subunit (E1b) | NP_390284 | EC 1.2.4.4 | express or Over-Express | make branched-chain acyl-CoA precursors | *Bacillus subtilis* |
| | bkdB | dihydrolipoyl transacetylase (E2) | NP_390283 | EC 2.3.1.168 | express or Over-Express | make branched-chain acyl-CoA precursors | *Bacillus subtilis* |
| | bkdA1 | branched-chain a-ketoacid dehydrogenase a-subunit (E1a) | AAA65614 | EC 1.2.4.4 | express or Over-Express | make branched-chain acyl-CoA precursors | *Pseudomonas putida* |
| | bkdA2 | branched-chain a-ketoacid dehydrogenase b-subunit | AAA65615 | EC 1.2.4.4 | express or Over-Express | make branched-chain acyl-CoA | *Pseudomonas putida* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | | (E1b) | | | | precursors | |
| | bkdC | dihydrolipoyl transacetylase (E2) | AAA65617 | EC 2.3.1.168 | express or Over-Express | make branched-chain acyl-CoA precursors | *Pseudomonas putida* |
| | lpd | dihydrolipoamide dehydrogenase (E3) | NP_414658 | 1.8.1.4 | express or Over-Express | make branched-chain acyl-CoA precursors | *Escherichia coli* |
| | IlvE | branched-chain amino acid aminotransferase | YP_026247 | 2.6.1.42 | express or Over-Express | make branched a-ketoacids | *Escherichia coli* |
| | IlvE | branched-chain amino acid aminotransferase | AAF34406 | 2.6.1.42 | express or Over-Express | make branched a-ketoacids | *Lactococcus lactis* |
| | IlvE | branched-chain amino acid aminotransferase | NP_745648 | 2.6.1.42 | express or Over-Express | make branched a-ketoacids | *Pseudomonas putida* |
| | IlvE | branched-chain amino acid aminotransferase | NP_629657 | 2.6.1.42 | express or Over-Express | make branched a-ketoacids | *Streptomyces coelicolor* |
| | ccr | crotonyl-CoA reductase | NP_630556 | 1.6.5.5,1.1.1.1 | express or Over-Express | Converting crotonyl-CoA to butyryl-CoA | *Streptomyces coelicolor* |
| | ccr | crotonyl-CoA reductase | AAD53915 | 1.6.5.5,1.1.1.1 | express or Over-Express | Converting crotonyl-CoA to butyryl-CoA | *Streptomyces cinnamonensis* |
| | IcmA, isobutyryl-CoA mutase | isobutyryl-CoA mutase, subunit A | NP_629554 | 5.4.99.2 | express or Over-Express | converting butyryl-CoA to isobutyryl-CoA | *Streptomyces coelicolor* |
| | IcmA, isobutyryl-CoA mutase | isobutyryl-CoA mutase, subunit A | AAC08713 | 5.4.99.2 | express or Over-Express | converting butyryl-CoA to isobutyryl-CoA | *Streptomyces cinnamonensis* |
| | IcmB, isobutyryl-CoA mutase | isobutyryl-CoA mutase, subunit B | NP_630904 | 5.4.99.2 | express or Over-Express | converting butyryl-CoA to isobutyryl-CoA | *Streptomyces coelicolor* |
| | IcmB, isobutyryl-CoA mutase | isobutyryl-CoA mutase, subunit B | CAB59633 | 5.4.99.2 | express or Over-Express | converting butyryl-CoA to isobutyryl-CoA | *Streptomyces cinnamonensis* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | FabH, ACPs and fabF genes with specificity for branched chain acyl-CoAs | | | | | | |
| | IlvE | branched-chain amino acid aminotransferase | CAC12788 | EC2.6.1.4 2 | over express | branched chain amino acid amino transferase | Staphylococcus carnosus |
| | FabH1 | beta-ketoacyl-ACP synthase III | NP_626634 | 2.3.1.180 | express or Over-Express | initiation of branched-chain fatty acid biosynthesis | Streptomyces coelicolor |
| | ACP | acyl-carrier protein | NP_626635 | NONE | express or Over-Express | initiation and elongation of branched-chain fatty acid biosynthesis | *Streptomyces coelicolor* |
| | FabF | beta-ketoacyl-ACP synthase II | NP_626636 | 2.3.1.179 | express or Over-Express | elongation of branched-chain fatty acid biosynthesis | *Streptomyces coelicolor* |
| | FabH3 | beta-ketoacyl-ACP synthase III | NP_823466 | 2.3.1.180 | express or Over-Express | initiation of branched-chain fatty acid biosynthesis | *Streptomyces avermitilis* |
| | FabC3 (ACP) | acyl-carrier protein | NP_823467 | NONE | express or Over-Express | initiation and elongation of branched-chain fatty acid biosynthesis | *Streptomyces avermitilis* |
| | FabF | beta-ketoacyl-ACP synthase II | NP_823468 | 2.3.1.179 | express or Over-Express | elongation of branched-chain fatty acid biosynthesis | *Streptomyces avermitilis* |
| | FabH_A | beta-ketoacyl-ACP synthase III | NP_389015 | 2.3.1.180 | express or Over-Express | initiation of branched-chain fatty acid | *Bacillus subtillis* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | | | | | | biosynthesis | |
| | FabH_B | beta-ketoacyl-ACP synthase III | NP_388898 | 2.3.1.180 | express or Over-Express | initiation of branched-chain fatty acid biosynthesis | *Bacillus subtillis* |
| | ACP | acyl-carrier protein | NP_389474 | NONE | express or Over-Express | initiation and elongation of branched-chain fatty acid biosynthesis | *Bacillus subtillis* |
| | FabF | beta-ketoacyl-ACP synthase II | NP_389016 | 2.3.1.179 | express or Over-Express | elongation of branched-chain fatty acid biosynthesis | *Bacillus subtillis* |
| | SmalDRAFT_0818 | beta-ketoacyl-ACP synthase III | ZP_01643059 | 2.3.1.180 | express or Over-Express | initiation of branched-chain fatty acid biosynthesis | *Stenotrophomonas maltophilia* |
| | SmalDRAFT_0821 | acyl-carrier protein | ZP_01643063 | NONE | express or Over-Express | initiation and elongation of branched-chain fatty acid biosynthesis | *Stenotrophomonas maltophilia* |
| | SmalDRAFT_0822 | beta-ketoacyl-ACP synthase II | ZP_01643064 | 2.3.1.179 | express or Over-Express | elongation of branched-chain fatty acid biosynthesis | *Stenotrophomonas maltophilia* |
| | FabH | beta-ketoacyl-ACP synthase III | YP_123672 | 2.3.1.180 | express or Over-Express | initiation of branched-chain fatty acid biosynthesis | *Legionella pneumophila* |
| | ACP | acyl-carrier protein | YP_123675 | NONE | express or Over-Express | initiation and elongation of branched-chain fatty acid biosynthesis | *Legionella pneumophila* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | FabF | beta-ketoacyl-ACP synthase II | YP_123676 | 2.3.1.179 | express or Over-Express | elongation of branched-chain fatty acid biosynthesis | *Legionella pneumophila* |
| | FabH | beta-ketoacyl-ACP synthase III | NP_415609 | 2.3.1.180 | delete or reduce | initiation of branched-chain fatty acid biosynthesis | *Escherichia coli* |
| | FabF | beta-ketoacyl-ACP synthase II | NP_415613 | 2.3.1.179 | delete or reduce | elongation of branched-chain fatty acid biosynthesis | *Escherichia coli* |
| *To Produce Cyclic Fatty Acids* | | | | | | | |
| | AnsJ | dehydratase (putative) | not available | not available | express or Over-Express | cyclohexylcarbonyl-CoA boiosynthesis | *Streptomyces collinus* |
| | AnsK | CoA ligase (putative) | not available | not available | express or Over-Express | cyclohexylcarbonyl-CoA boiosynthesis | *Streptomyces collinus* |
| | AnsL | dehydrogenase (putative) | not available | not available | express or Over-Express | cyclohexylcarbonyl-CoA boiosynthesis | *Streptomyces collinus* |
| | ChcA | enoyl-CoA reductase | U72144 | EC 1.3.1.34 | express or Over-Express | cyclohexylcarbonyl-CoA boiosynthesis | *Streptomyces collinus* |
| | AnsM | oxidorecutase (putative) | not available | not available | express or Over-Express | cyclohexylcarbonyl-CoA boiosynthesis | *Streptomyces collinus* |
| | PlmJ | dehydratase (putative) | AAQ84158 | not available | express or Over-Express | cyclohexylcarbonyl-CoA boiosynthesis | *Streptomyces sp. HK803* |
| | PlmK | CoA ligase (putative) | AAQ84158 | not available | express or Over-Express | cyclohexylcarbonyl-CoA boiosynthesis | *Streptomyces sp. HK803* |
| | PlmL | dehydrogenase (putative) | AAQ84159 | not available | express or Over-Express | cyclohexylcarbonyl-CoA boiosynthesis | *Streptomyces sp. HK803* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | ChcA | enoyl-CoA reductase | AAQ84160 | EC 1.3.1.34 | express or Over-Express | cyclohexylcarbonyl-CoA boiosynthesis | *Streptomyces sp. HK803* |
| | PlmM | oxidorecutase (putative) | AAQ84161 | not available | express or Over-Express | cyclohexylcarbonyl-CoA boiosynthesis | *Streptomyces sp. HK803* |
| | ChcB | enoyl-CoA isomerase | AF268489 | not available | express or Over-Express | cyclohexylcarbonyl-CoA boiosynthesis | *Streptomyces collinus* |
| | ChcB/CaiD | enoyl-CoA isomerase | NP_629292 | 4.2.1.- | express or Over-Express | cyclohexylcarbonyl-CoA boiosynthesis | *Streptomyces coelicolor* |
| | ChcB/CaiD | enoyl-CoA isomerase | NP_824296 | 4.2.1.- | express or Over-Express | cyclohexylcarbonyl-CoA boiosynthesis | *Streptomyces avermitilis* |
| | | | | | | | |
| 2C. Saturation Level Control | | | | | | | |
| | Sfa | Suppressor of FabA | AAN79592, AAC44390 | NONE | Over-express | increase monounsaturated fatty acids | *E.coli* |
| | also *see* FabA in sec. 1 | | | | express | produce unsaturated fatty acids | |
| | GnsA | suppressors of the secG null mutation | ABD18647.1 | NONE | Over-express | increase unsaturated fatty acid esters | *E.coli* |
| | GnsB | suppressors of the secG null mutation | AAC74076.1 | NONE | Over-express | increase unsaturated fatty acid esters | *E.coli* |
| | also *see* section 2A - items with :0 are unsaturated (no double bonds) and with :1 are saturated (1 double bond) | | | | | | |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | fabB | 3-oxoacyl-[acyl-carrier-protein] synthase I | BAA16180 | EC:2.3.1.41 | overexpress | modulate unsaturated fatty acid production | *Escherichia coli* |
| | fabK | trans-2-enoyl-ACP reductase II | AAF98273 | 1.3.1.9 | express | modulate unsaturated fatty acid production | *Streptococcus pneumoniae* |
| | fabL | enoyl-(acyl carrier protein) reductase | AAU39821 | 1.3.1.9 | express | modulate unsaturated fatty acid production | *Bacillus licheniformis DSM 13* |
| | fabM | trans-2, cis-3-decenoyl-ACP isomerase | DAA05501 | 4.2.1.17 | Over-express | modulate unsaturated fatty acid production | *Streptococcus mutans* |
| | | | | | | | |
| Fatty Aldehyde Output | | | | | | | |
| | thioesterase | *see* chain length control section | | | express | produce | |
| Export | | | | | | | |
| | Wax ester exporter (FATP family, Fatty Acid (long chain) Transport Protein) | | NP_524723 | NONE | express | export wax | *Drosophila melanogaster* |
| | ABC transport protein | putative alkane transporter | AAN73268 | NONE | express | export products | *Rhodococcus erythropolis* |
| | CER5 | wax transporter | At1g51500, AY734542, At3g21090, At1g51460 | NONE | express | export products | *Arabidopsis thaliana* |
| | AtMRP5 | Arabidopsis thaliana multidrug resistance-associated | NP_171908 | NONE | express | export products | *Arabidopsis thaliana* |
| | AmiS2 | ABC transporter AmiS2 | JC5491 | NONE | express | export products | *Rhodococcus sp.* |
| | AtPGP1 | ARABIDOPSIS THALIANA P | NP_181228 | NONE | express | export products | *Arabidopsis thaliana* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | | GLYCOPROTEIN1 | | | | | |
| | AcrA | putative multidrug-efflux transport protein acrA | CAF23274 | NONE | express | export products | *Candidatus Protochlamydia amoebophila UWE25* |
| | AcrB | probable multidrug-efflux transport protein, acrB | CAF23275 | NONE | express | export products | *Candidatus Protochlamydia amoebophila UWE25* |
| | TolC | Outer membrane protein [Cell envelope biogenesis, | ABD59001 | NONE | express | export products | *Francisella tularensis subsp. novicida* |
| | AcrE | transmembrane protein affects septum formation and cell membrane permeability | YP 312213 | NONE | express | export products | *Shigella sonnei Ss046* |
| | AcrF | Acriflavine resistance protein F | P24181 | NONE | express | export products | *Escherichia coli* |
| | tll1618 | multidrug efflux transporter | NP 682408.1 | NONE | express | export products | *Thermosynechococcus elongatus BP-1]* |
| | tll1619 | multidrug efflux transporter | NP 682409.1 | NONE | express | export products | *Thermosynechococcus elongatus BP-1]* |
| | tll0139 | multidrug efflux transporter | NP 680930.1 | NONE | express | export products | *Thermosynechococcus elongatus BP-1]* |
| | | | | | | | |
| 5. Fermentation | | | | | | | |
| | replication checkpoint genes | | | | | increase output efficiency | |
| | umuD | DNA polymerase V, subunit | YP 310132 | 3.4.21.- | Over-express | increase output efficiency | *Shigella sonnei Ss046* |

FIG. 5 (Cont.)

*Accession Numbers are from NCBI, GenBank, Release 159.0 as of March 2008*
*EC Numbers are from KEGG, Release 42.0 as of April 2007 (plus daily updates up to March 2008)*

| | | | | | | | |
|---|---|---|---|---|---|---|---|
| | umuC | DNA polymerase V, subunit | ABC42261 | 2.7.7.7 | Over-express | increase output efficiency | *Escherichia coli* |
| | NADH:NADPH transhydrogenase (alpha and beta subunits) (pntA, pntB) | | P07001, P0AB70 | 1.6.1.2 | express | increase output efficiency | *Shigella flexneri* |

FIG. 6

| Gene | Name | Nucleotide Sequence | Protein Sequence |
|---|---|---|---|
| fabA | beta-hydroxydecanoyl thioester dehydrase | atgGTAGATA AACGCGAATC CTATACAAAA GAAGACCTTC TTGCCTCTGG TCGCGGTGAA CTGTTTGGCG CTAAAGGCCC GCAATTGCCA GCACCGAACA TGCTGATGAT GGACCGTGTG GTCAAAATGA CCGAAACGGG TGGTAACTTC GACAAAGGGT ATGTTGAAGC AGAACTGGAT ATCAATCCGG ATCTGTGGTT CTTCGGATGC CACTTTATTG GCGATCCGGT TATGCCGGGA TGCCTGGGCC TGGACGCAAT GTGGCAGCTG GTAGGGTTCT ACCTCGGCTG GCTGGGCGGC GAAGGTAAAG GCCGCGCGCT GGGCGTTGGC GAAGTGAAAT TCACTGGTCA GGTACTGCCG ACAGCGAAAA AAGTGACCTA CCGTATTCAC TTTAAACGCA TTGTTAACCG TCGTCTGATT ATGGGCCTGG CGGATGGCGA AGTGCTGGTT GATGGTCGTC TGATCTATAC CGCCAGCGAC CTGAAAGTCG GTCTGTTCCA GGATACGTCT GCCTTCTGA (SEQ ID NO:93) | MVDKRESYTK EDLLASGRGE LFGAKGPQLP APNMLMMDRV VKMTETGGNF DKGYVEAELD INPDLWFFGC HFIGDPVMPG CLGLDAMWQL VGFYLGWLGG EGKGRALGVG EVKFTGQVLP TAKKVTYRIH FKRIVNRRLI MGLADGEVLV DGRLIYTASD LKVGLFQDTS AF (SEQ ID NO:94) |
| fabZ | (3R)-hydroxymyristol acyl carrier protein dehydratase | ttgACTACTA ACACTCATAC TCTGCAGATT GAAGAGATTT TAGAACTTCT GCCGCACCGT TTCCCGTTCT TACTGGTGGA TCGCGTGCTG GATTTTGAAG AAGGTCGTTT TCTGCGCGCA GTAAAAAATG TCTCTGTCAA TGAGCCATTC TTCCAGGGCC ATTTCCCTGG AAAACCGATT TTCCCGGGTG TGCTGATTCT GGAAGCAATG GCACAGGCAA CAGGTATTCT GGCGTTTAAA AGCGTAGGAA AACTGGAACC GGGTGAGCTG TACTACTTCG CTGGTATTGA CGAAGCGCGC TTCAAGCGCC CGGTCGTGCC TGGCGATCAA ATGATCATGG AAGTCACTTT CGAAAAAACG CGCCGCGGCC TGACCCGTTT TAAAGGGGTT GCTCTGGTCG ATGGTAAAGT AGTTTGCGAA GCAACGATGA TGTGTGCTCG TAGCCGGGAG GCCTGA (SEQ ID | MTTNTHTLQI EEILELLPHR FPFLLVDRVL DFEEGRFLRA VKNVSVNEPF FQGHFPGKPI FPGVLILEAM AQATGILAFK SVGKLEPGEL YYFAGIDEAR FKRPVVPGDQ MIMEVTFEKT RRGLTRFKGV ALVDGKVVCE ATMMCARSRE A (SEQ ID NO:96) |

FIG. 6 (Cont.)

| | | | |
|---|---|---|---|
| | | NO:95) | |
| cysM | cysteine synthase B (O-acetylserine sulfhydrolase B) | gtgAGTACAT TAGAACAAAC AATAGGCAAT ACGCCTCTGG TGAAGTTGCA GCGAATGGGG CCGGATAACG GCAGTGAAGT GTGGTTAAAA CTGGAAGGCA ATAACCCGGC AGGTTCGGTG AAAGATCGTG CGGCACTTTC GATGATCGTC GAGGCGGAAA AGCGCGGGGA AATTAAACCG GGTGATGTCT TAATCGAAGC CACCAGTGGT AACACCGGCA TTGCGCTGGC AATGATTGCC GCGCTGAAAG GCTATCGCAT GAAATTGCTG ATGCCCGACA ACATGAGCCA GGAACGCCGT GCGGCGATGC GTGCTTATGG TGCGGAACTG ATTCTTGTCA CCAAAGAGCA GGGCATGGAA GGTGCGCGCG ATCTGGCGCT GGAGATGGCG AATCGTGGCG AAGGAAAGCT GCTCGATCAG TTCAATAATC CCGATAACCC TTATGCGCAT TACACCACCA CTGGGCCGGA AATCTGGCAG CAAACCGGCG GGCGCATCAC TCATTTTGTC TCCAGCATGG GGACGACCGG CACTATCACC GGCGTCTCAC GCTTTATGCG CGAACAATCC AAACCGGTGA CCATTGTCGG CCTGCAACCG GAAGAGGGCA GCAGCATTCC CGGCATTCGC CGCTGGCCTA CGGAATATCT GCCGGGGATT TTCAACGCTT CTCTGGTGGA TGAGGTGCTG GATATTCATC AGCGCGATGC GGAAAACACC ATGCGCGAAC TGGCGGTGCG GGAAGGAATA TTCTGTGGCG TCAGCTCCGG CGGCGCGGTT GCCGGAGCAC TGCGGGTGGC AAAAGCTAAC CCTGACGCGG TGGTGGTGGC GATCATCTGC GATCGTGGCG ATCGCTACCT TTCTACCGGG GTGTTTGGGG AAGAGCATTT TAGCCAGGGG GCGGGGATTT AA (SEQ ID NO:97) | MSTLEQTIGN TPLVKLQRMG PDNGSEVWLK LEGNNPAGSV KDRAALSMIV EAEKRGEIKP GDVLIEATSG NTGIALAMIA ALKGYRMKLL MPDNMSQERR AAMRAYGAEL ILVTKEQGME GARDLALEMA NRGEGKLLDQ FNNPDNPYAH YTTTGPEIWQ QTGGRITHFV SSMGTTGTIT GVSRFMREQS KPVTIVGLQP EEGSSIPGIR RWPTEYLPGI FNASLVDEVL DIHQRDAENT MRELAVREGI FCGVSSGGAV AGALRVAKAN PDAVVVAIIC DRGDRYLSTG VFGEEHFSQG AGI (SEQ ID NO:98) |
| maoC | fused aldehyde dehydrogenase/enoyl-CoA hydratase | atgCAGCAGT TAGCCAGTTT CTTATCCGGT ACCTGGCAGT CTGGCCGGGG CCGTAGCCGT TTGATTCACC ACGCTATTAG CGGCGAGGCG TTATGGGAAG TGACCAGTGA AGGTCTTGAT | MQQLASFLSG TWQSGRGRSR LIHHAISGEA LWEVTSEGLD MAAARQFAIE KGAPALRAMT |

FIG. 6 (Cont.)

| | | | |
|---|---|---|---|
| | | ATGGCGGCTG CCCGCCAGTT | FIERAAMLKA |
| | | TGCCATTGAA AAAGGTGCCC | VAKHLLSEKE |
| | | CCGCCCTTCG CGCTATGACC | RFYALSAQTG |
| | | TTTATCGAAC GTGCGGCGAT | ATRADSWVDI |
| | | GCTTAAAGCG GTCGCTAAAC | EGGIGTLFTY |
| | | ATCTGCTGAG TGAAAAAGAG | ASLGSRELPD |
| | | CGTTTCTATG CTCTTTCTGC | DTLWPEDELI |
| | | GCAAACAGGC GCAACGCGGG | PLSKEGGFAA |
| | | CAGACAGTTG GGTTGATATT | RHLLTSKSGV |
| | | GAAGGTGGCA TTGGGACGTT | AVHINAFNFP |
| | | ATTTACTTAC GCCAGCCTCG | CWGMLEKLAP |
| | | GTAGCCGGGA GCTGCCTGAC | TWLGGMPAII |
| | | GATACGCTGT GGCCGGAAGA | KPATATAQLT |
| | | TGAATTGATC CCCTTATCGA | QAMVKSIVDS |
| | | AAGAAGGTGG ATTTGCCGCG | GLVPEGAISL |
| | | CGCCATTTAC TGACCTCAAA | ICGSAGDLLD |
| | | GTCAGGCGTG GCAGTGCATA | HLDSQDVVTF |
| | | TTAACGCCTT TAACTTCCCC | TGSAATGQML |
| | | TGCTGGGGAA TGCTGGAAAA | RVQPNIVAKS |
| | | GCTGGCACCA ACGTGGCTGG | IPFTMEADSL |
| | | GCGGAATGCC AGCCATCATC | NCCVLGEDVT |
| | | AAACCAGCTA CCGCGACGGC | PDQPEFALFI |
| | | CCAACTGACT CAGGCGATGG | REVVREMTTK |
| | | TGAAATCAAT TGTCGATAGT | AGQKCTAIRR |
| | | GGTCTTGTTC CCGAAGGCGC | IIVPQALVNA |
| | | AATTAGTCTG ATCTGCGGTA | VSDALVARLQ |
| | | GTGCTGGCGA CTTGTTGGAT | KVVVGDPAQE |
| | | CATCTGGACA GCCAGGATGT | GVKMGALVNA |
| | | GGTGACTTTC ACGGGGTCAG | EQRADVQEKV |
| | | CGGCGACCGG ACAGATGCTG | NILLAAGCEI |
| | | CGAGTTCAGC CAAATATCGT | RLGGQADLSA |
| | | CGCCAAATCT ATCCCCTTCA | AGAFFPPTLL |
| | | CTATGGAAGC TGATTCCCTG | YCPQPDETPA |
| | | AACTGCTGCG TACTGGGCGA | VHATEAFGPV |
| | | AGATGTCACC CCGGATCAAC | ATLMPAQNQR |
| | | CGGAGTTTGC GCTGTTTATT | HALQLACAGG |
| | | CGTGAAGTTG TGCGTGAGAT | GSLAGTLVTA |
| | | GACCACAAAA GCCGGGCAAA | DPQIARQFIA |
| | | AATGTACGGC AATCCGGCGG | DAARTHGRIQ |
| | | ATTATTGTGC CGCAGGCATT | ILNEESAKES |
| | | GGTTAATGCT GTCAGTGATG | TGHGSPLPQL |
| | | CTCTGGTTGC GCGATTACAG | VHGGPGRAGG |
| | | AAAGTCGTGG TCGGTGATCC | GEELGGLRAV |
| | | TGCTCAGGAA GGCGTGAAAA | KHYMQRTAVQ |
| | | TGGGCGCACT GGTAAATGCT | GSPTMLAAIS |
| | | GAGCAGCGTG CCGATGTGCA | KQWVRGAKVE |
| | | GGAAAAAGTG AACATATTGC | EDRIHPFRKY |
| | | TGGCTGCAGG ATGCGAGATT | FEELQPGDSL |
| | | CGCCTCGGTG GTCAGGCGGA | LTPRRTMTEA |
| | | TTTATCTGCT GCGGGTGCCT | DIVNFACLSG |
| | | TCTTCCCGCC AACCTTATTG | DHFYAHMDKI |
| | | TACTGTCCGC AGCCGGATGA | AAAESIFGER |
| | | AACACCGGCG GTACATGCAA | VVHGYFVLSA |
| | | CAGAAGCCTT TGGCCCTGTC | AAGLFVDAGV |
| | | GCAACGCTGA TGCCAGCACA | GPVIANYGLE |
| | | AAACCAGCGA CATGCTCTGC | SLRFIEPVKP |
| | | AACTGGCTTG TGCAGGCGGC | GDTIQVRLTC |

FIG. 6 (Cont.)

| | | | |
|---|---|---|---|
| | | GGTAGCCTTG CGGGAACGCT GGTGACGGCT GATCCGCAAA TTGCGCGTCA GTTTATTGCC GACGCGGCAC GTACGCATGG GCGAATTCAG ATCCTCAATG AAGAGTCGGC AAAAGAATCC ACCGGGCATG GCTCCCCACT GCCACAACTG GTACATGGTG GGCCTGGTCG CGCAGGAGGC GGTGAAGAAT TAGGCGGTTT ACGAGCGGTG AAACATTACA TGCAGCGAAC CGCTGTTCAG GGTAGTCCGA CGATGCTTGC CGCTATCAGT AAACAGTGGG TGCGCGGTGC GAAAGTCGAA GAAGATCGTA TTCATCCGTT CCGCAAATAT TTTGAGGAGC TACAACCAGG CGACAGCCTG TTGACTCCCC GCCGCACAAT GACAGAGGCC GATATTGTTA ACTTTGCTTG CCTCAGCGGC GATCATTTCT ATGCACATAT GGATAAGATT GCTGCTGCCG AATCTATTTT CGGTGAGCGG GTGGTGCATG GGTATTTTGT GCTTTCTGCG GCTGCGGGTC TGTTTGTCGA TGCCGGTGTC GGTCCGGTCA TTGCTAACTA CGGGCTGGAA AGCTTGCGTT TTATCGAACC CGTAAAGCCA GGCGATACCA TCCAGGTGCG TCTCACCTGT AAGCGCAAGA CGCTGAAAAA ACAGCGTAGC GCAGAAGAAA AACCAACAGG TGTGGTGGAA TGGGCTGTAG AGGTATTCAA TCAGCATCAA ACCCCGGTGG CGCTGTATTC AATTCTGACG CTGGTGGCCA GGCAGCACGG TGATTTTGTC GATTAA (SEQ ID NO:99) | KRKTLKKQRS AEEKPTGVVE WAVEVFNQHQ TPVALYSILT LVARQHGDFV D (SEQ ID NO:100) |

| Source | Genbank Accession Number |
|---|---|
| Shigella sp. D9 | ZP_05432652 |
| Citrobacter youngae ATCC 29220 | ZP_04561391.1 |
| Salmonella enterica | YP_001570967.1 |
| Escherichia fergusonii ATCC 35469 | YP_002382254.1 |

FIG. 6 (Cont.)

| | |
|---|---|
| Klebsiella pneumoniae NTUH-K2044 | YP_002918743.1 |
| Enterobacter cancerogenus ATCC 35316 | ZP_03281954.1 |
| Cronobacter turicensis | CBA29728.1 |
| Erwinia pyrifoliae Ep1/96 | YP_002649242.1 |
| Pectobacterium carotovorum subsp. carotovorum PC1 | YP_003018119.1 |
| Dickeya dadantii Ech703 | YP_002987184.1 |
| Edwardsiella ictaluri 93-146 | YP_002932813.1 |
| Providencia alcalifaciens DSM 30120 | ZP_03317956.1 |
| Yersinia kristensenii ATCC 33638 | ZP_04624337.1 |
| Photorhabdus asymbiotica | YP_003041580.1 |
| Pantoea sp. At-9b | ZP_05728924.1 |
| Actinobacillus succinogenes 130Z | YP_001344737.1 |
| Mannheimia succiniciproducens MBEL55E | YP_088386.1 |
| Pasteurella multocida subsp. multocida str. Pm70 | NP_245421.1 |
| Haemophilus somnus 129PT | YP_719117.1 |
| Proteus mirabilis HI4320 | YP_002150544.1 |
| Sodalis glossinidius str. 'morsitans' | YP_454706.1 |

FIG. 6 (Cont.)

| | |
|---|---|
| Candidatus Blochmannia pennsylvanicus str. BPEN | YP_277927.1 |
| Aggregatibacter aphrophilus NJ8700 | YP_003007342.1 |
| Vibrio cholerae MZO-3 | ZP_01958381.1 |
| Baumannia cicadellinicola str. Hc (Homalodisca coagulata) | YP_588853.1 |
| Vibrionales bacterium SWAT-3 | ZP_01815187.1 |
| Aliivibrio salmonicida LFI1238 | YP_002262988.1 |
| Aeromonas salmonicida subsp. salmonicida A449 | YP_001141819.1 |
| Wigglesworthia glossinidia endosymbiont of Glossina brevipalpis | NP_871303.1 |
| Glaciecola sp. HTCC2999 | ZP_03560821.1 |
| Alteromonas macleodii ATCC 27126 | ZP_04714556.1 |

FIG. 7

| Gene | Name | Nucleotide Sequence | Protein Sequence |
|---|---|---|---|
| fabB | B-ketoacyl synthase/ 3-oxoacyl-[acyl-carrier-protein] synthase I | atgAAACGTG CAGTGATTAC TGGCCTGGGC ATTGTTTCCA GCATCGGTAA TAACCAGCAG GAAGTCCTGG CATCTCTGCG TGAAGGACGT TCAGGGATCA CTTTCTCTCA GGAGCTGAAG GATTCCGGCA TGCGTAGCCA CGTCTGGGGC AACGTAAAAC TGGATACCAC TGGCCTCATT GACCGCAAAG TTGTGCGCTT TATGAGCGAC GCATCCATTT ATGCATTCCT TTCTATGGAG CAGGCAATCG CTGATGCGGG CCTCTCTCCG GAAGCTTACC AGAATAACCC GCGCGTTGGC CTGATTGCAG GTTCCGGCGG CGGCTCCCCG CGTTTCCAGG TGTTCGGCGC TGACGCAATG CGCGGCCCGC GCGGCCTGAA AGCGGTTGGC CCGTATGTGG TCACCAAAGC GATGGCATCC GGCGTTTCTG CCTGCCTCGC CACCCCGTTT AAAATTCATG GCGTTAACTA CTCCATCAGC TCCGCGTGTG CGACTTCCGC ACACTGTATC GGTAACGCAG TAGAGCAGAT CCAACTGGGC AAACAGGACA TCGTGTTTGC TGGCGGCGGC GAAGAGCTGT GCTGGGAAAT GGCTTGCGAA TTCGACGCAA TGGGTGCGCT GTCTACTAAA TACAACGACA CCCCGGAAAA AGCCTCCCGT ACTTACGACG CTCACCGTGA CGGTTTCGTT ATCGCTGGCG GCGGCGGTAT GGTAGTGGTT GAAGAGCTGG AACACGCGCT GGCGCGTGGT GCTCACATCT ATGCTGAAAT CGTTGGCTAC GGCGCAACCT CTGATGGTGC AGACATGGTT GCTCCGTCTG GCGAAGGCGC AGTACGCTGC ATGAAGATGG CGATGCATGG CGTTGATACC CCAATCGATT ACCTGAACTC CCACGGTACT TCGACTCCGG TTGGCGACGT GAAAGAGCTG GCAGCTATCC GTGAAGTGTT CGGCGATAAG AGCCCGGCGA TTTCTGCAAC CAAAGCCATG ACCGGTCACT | MKRAVITGLG IVSSIGNNQQ EVLASLREGR SGITFSQELK DSGMRSHVWG NVKLDTTGLI DRKVVRFMSD ASIYAFLSME QAIADAGLSP EAYQNNPRVG LIAGSGGGSP RFQVFGADAM RGPRGLKAVG PYVVTKAMAS GVSACLATPF KIHGVNYSIS SACATSAHCI GNAVEQIQLG KQDIVFAGGG EELCWEMACE FDAMGALSTK YNDTPEKASR TYDAHRDGFV IAGGGMVVV EELEHALARG AHIYAEIVGY GATSDGADMV APSGEGAVRC MKMAMHGVDT PIDYLNSHGT STPVGDVKEL AAIREVFGDK SPAISATKAM TGHSLGAAGV QEAIYSLLML EHGFIAPSIN IEELDEQAAG LNIVTETTDR ELTTVMSNSF GFGGTNATLV MRKLKD (SEQ ID NO:102) |

FIG. 7 (Cont.)

| | | | |
|---|---|---|---|
| | | CTCTGGGCGC TGCTGGCGTA<br>CAGGAAGCTA TCTACTCTCT<br>GCTGATGCTG GAACACGGCT<br>TTATCGCCCC GAGCATCAAC<br>ATTGAAGAGC TGGACGAGCA<br>GGCTGCGGGT CTGAACATCG<br>TGACCGAAAC GACCGATCGC<br>GAACTGACCA CCGTTATGTC<br>TAACAGCTTC GGCTTCGGCG<br>GCACCAACGC CACGCTGGTA<br>ATGCGCAAGC TGAAAGATTA A<br>(SEQ ID NO:101) | |
| **fabF** | 3-oxoacyl-[acyl-carrier-protein] synthase II | gtgTCTAAGC GTCGTGTAGT<br>TGTGACCGGA CTGGGCATGT<br>TGTCTCCTGT CGGCAATACC<br>GTAGAGTCTA CCTGGAAAGC<br>TCTGCTTGCC GGTCAGAGTG<br>GCATCAGCCT AATCGACCAT<br>TTCGATACTA GCGCCTATGC<br>AACGAAATTT GCTGGCTTAG<br>TAAAGGATTT TAACTGTGAG<br>GACATTATCT CGCGCAAAGA<br>ACAGCGCAAG ATGGATGCCT<br>TCATTCAATA TGGAATTGTC<br>GCTGGCGTTC AGGCCATGCA<br>GGATTCTGGC CTTGAAATAA<br>CGGAAGAGAA CGCAACCCGC<br>ATTGGTGCCG CAATTGGCTC<br>CGGGATTGGC GGCCTCGGAC<br>TGATCGAAGA AAACCACACA<br>TCTCTGATGA ACGGTGGTCC<br>ACGTAAGATC AGCCCATTCT<br>TCGTTCCGTC AACGATTGTG<br>AACATGGTGG CAGGTCATCT<br>GACTATCATG TATGGCCTGC<br>GTGGCCCGAG CATCTCTATC<br>GCGACTGCCT GTACTTCCGG<br>CGTGCACAAC ATTGGCCATG<br>CTGCGCGTAT TATCGCGTAT<br>GGCGATGCTG ACGTGATGGT<br>TGCAGGTGGC GCAGAGAAAG<br>CCAGTACGCC GCTGGGCGTT<br>GGTGGTTTTG GCGCGGCACG<br>TGCATTATCT ACCCGCAATG<br>ATAACCCGCA AGCGGCGAGC<br>CGCCCGTGGG ATAAAGAGCG<br>TGATGGTTTC GTACTGGGCG<br>ATGGTGCCGG TATGCTGGTA<br>CTTGAAGAGT ACGAACACGC<br>GAAAAAACGC GGTGCGAAAA<br>TTTACGCTGA ACTCGTCGGC<br>TTTGGTATGA GCAGCGATGC<br>TTATCATATG ACGTCACCGC<br>CAGAAAATGG CGCAGGCGCA<br>GCTCTGGCGA TGGCAAATGC | MSKRRVVVTG<br>LGMLSPVGNT<br>VESTWKALLA<br>GQSGISLIDH<br>FDTSAYATKF<br>AGLVKDFNCE<br>DIISRKEQRK<br>MDAFIQYGIV<br>AGVQAMQDSG<br>LEITEENATR<br>IGAAIGSGIG<br>GLGLIEENHT<br>SLMNGGPRKI<br>SPFFVPSTIV<br>NMVAGHLTIM<br>YGLRGPSISI<br>ATACTSGVHN<br>IGHAARIIAY<br>GDADVMVAGG<br>AEKASTPLGV<br>GGFGAARALS<br>TRNDNPQAAS<br>RPWDKERDGF<br>VLGDGAGMLV<br>LEEYEHAKKR<br>GAKIYAELVG<br>FGMSSDAYHM<br>TSPPENGAGA<br>ALAMANALRD<br>AGIEASQIGY<br>VNAHGTSTPA<br>GDKAEAQAVK<br>TIFGEAASRV<br>LVSSTKSMTG<br>HLLGAAGAVE<br>SIYSILALRD<br>QAVPPTINLD<br>NPDEGCDLDF<br>VPHEARQVSG<br>MEYTLCNSFG<br>FGGTNGSLIF KKI (SEQ ID NO:104) |

FIG. 7 (Cont.)

| | | | |
|---|---|---|---|
| | | TCTGCGTGAT GCAGGCATTG AAGCGAGTCA GATTGGCTAC GTTAACGCGC ACGGTACTTC TACGCCGGCT GGCGATAAAG CTGAAGCGCA GGCGGTGAAA ACCATCTTCG GTGAAGCTGC AAGCCGTGTG TTGGTAAGCT CCACGAAATC TATGACCGGT CACCTGTTAG GTGCGGCGGG TGCAGTAGAA TCTATCTACT CCATCCTGGC GCTGCGCGAT CAGGCTGTTC CGCCAACCAT CAACCTGGAT AACCCGGATG AAGGTTGCGA TCTGGATTTC GTACCGCACG AAGCGCGTCA GGTTAGCGGA ATGGAATACA CTCTGTGTAA CTCCTTCGGC TTCGGTGGCA CTAATGGTTC TTTGATCTTT AAAAAGATCT AA (SEQ ID NO:103) | |
| **fadJ** | fused enoyl-CoA hydratase and epimerase and isomerase/3-hydroxyacyl-CoA dehydrogenase | atgGAAATGA CATCAGCGTT TACCCTTAAT GTTCGTCTGG ACAACATTGC CGTTATCACC ATCGACGTAC CGGGTGAGAA AATGAATACC CTGAAGGCGG AGTTTGCCTC GCAGGTGCGC GCCATTATTA AGCAACTCCG TGAAAACAAA GAGTTGCGAG GCGTGGTGTT TGTCTCCGCT AAACCGGACA ACTTCATTGC TGGCGCAGAC ATCAACATGA TCGGCAACTG CAAAACGGCG CAAGAAGCGG AAGCTCTGGC GCGGCAGGGC CAACAGTTGA TGGCGGAGAT TCATGCTTTG CCCATTCAGG TTATCGCGGC TATTCATGGC GCTTGCCTGG GTGGTGGGCT GGAGTTGGCG CTGGCGTGCC ACGGTCGCGT TTGTACTGAC GATCCTAAAA CGGTGCTCGG TTTGCCTGAA GTACAACTTG GATTGTTACC CGGTTCAGGC GGCACCCAGC GTTTACCGCG TCTGATAGGC GTCAGCACAG CATTAGAGAT GATCCTCACC GGAAAACAAC TTCGGGCGAA ACAGGCATTA AAGCTGGGGC TGGTGGATGA CGTTGTTCCG CACTCCATTC TGCTGGAAGC CGCTGTTGAG CTGGCAAAGA AGGAGCGCCC ATCTTCCCGC CCTCTACCTG TACGCGAGCG TATTCTGGCG GGGCCGTTAG GTCGTGCGCT GCTGTTCAAA ATGGTCGGCA | MEMTSAFTLN VRLDNIAVIT IDVPGEKMNT LKAEFASQVR AIIKQLRENK ELRGVVFVSA KPDNFIAGAD INMIGNCKTA QEAEALARQG QQLMAEIHAL PIQVIAAIHG ACLGGGLELA LACHGRVCTD DPKTVLGLPE VQLGLLPGSG GTQRLPRLIG VSTALEMILT GKQLRAKQAL KLGLVDDVVP HSILLEAAVE LAKKERPSSR PLPVRERILA GPLGRALLFK MVGKKTEHKT QGNYPATERI LEVVETGLAQ GTSSGYDAEA RAFGELAMTP QSQALRSIFF ASTDVKKDPG SDAPPAPLNS VGILGGGLMG GGIAYVTACK AGIPVRIKDI NPQGINHALK |

FIG. 7 (Cont.)

| | | | |
|---|---|---|---|
| | | AGAAAACAGA ACACAAAACT | YSWDQLEGKV |
| | | CAAGGCAATT ATCCGGCGAC | RRRHLKASER |
| | | AGAACGCATC CTGGAGGTTG | DKQLALISGT |
| | | TTGAAACGGG ATTAGCGCAG | TDYRGFAHRD |
| | | GGCACCAGCA GCGGTTATGA | LIIEAVFENL |
| | | CGCCGAAGCT CGGGCGTTTG | ELKQQMVAEV |
| | | GCGAACTGGC GATGACGCCA | EQNCAAHTIF |
| | | CAATCGCAGG CGCTGCGTAG | ASNTSSLPIG |
| | | TATCTTTTTT GCCAGTACGG | DIAAHATRPE |
| | | ACGTGAAGAA AGATCCCGGC | QVIGLHFFSP |
| | | AGTGATGCGC CGCCTGCGCC | VEKMPLVEII |
| | | ATTAAACAGC GTGGGGATTT | PHAGTSAQTI |
| | | TAGGTGGTGG CTTGATGGGC | ATTVKLAKKQ |
| | | GGCGGTATTG CTTATGTCAC | GKTPIVVRDK |
| | | TGCTTGTAAA GCGGGGATTC | AGFYVNRILA |
| | | CGGTCAGAAT TAAAGATATC | PYINEAIRML |
| | | AACCCGCAGG GCATAAATCA | TQGERVEHID |
| | | TGCGCTGAAG TACAGTTGGG | AALVKFGFPV |
| | | ATCAGCTGGA GGGCAAAGTT | GPIQLLDEVG |
| | | CGCCGTCGTC ATCTCAAAGC | IDTGTKIIPV |
| | | CAGCGAACGT GACAAACAGC | LEAAYGERFS |
| | | TGGCATTAAT CTCCGGAACG | APANVVSSIL |
| | | ACGGACTATC GCGGCTTTGC | NDDRKGRKNG |
| | | CCATCGCGAT CTGATTATTG | RGFYLYGQKG |
| | | AAGCGGTGTT TGAAAATCTC | RKSKKQVDPA |
| | | GAATTGAAAC AACAGATGGT | IYPLIGTQGQ |
| | | GGCGGAAGTT GAGCAAAATT | GRISAPQVAE |
| | | GCGCCGCTCA TACCATCTTT | RCVMLMLNEA |
| | | GCTTCGAATA CGTCATCTTT | VRCVDEQVIR |
| | | ACCGATTGGT GATATCGCCG | SVRDGDIGAV |
| | | CTCACGCCAC GCGACCTGAG | FGIGFPPFLG |
| | | CAAGTTATCG GCCTGCATTT | GPFRYIDSLG |
| | | CTTCAGTCCG GTGGAAAAAA | AGEVVAIMQR |
| | | TGCCGCTGGT GGAGATTATT | LATQYGSRFT |
| | | CCTCATGCGG GGACATCGGC | PCERLVEMGA |
| | | GCAAACCATC GCTACCACAG | RGESFWKTTA TDLQ |
| | | TAAAACTGGC GAAAAAACAG | (SEQ ID NO:106) |
| | | GGTAAAACGC CAATTGTCGT | |
| | | GCGTGACAAA GCCGGTTTTT | |
| | | ACGTCAATCG CATCTTAGCG | |
| | | CCTTACATTA ATGAAGCTAT | |
| | | CCGCATGTTG ACCCAAGGTG | |
| | | AACGGGTAGA GCACATTGAT | |
| | | GCCGCGCTAG TGAAATTTGG | |
| | | TTTTCCGGTA GGCCCAATCC | |
| | | AACTTTTGGA TGAGGTAGGA | |
| | | ATCGACACCG GGACTAAAAT | |
| | | TATTCCTGTA CTGGAAGCCG | |
| | | CTTATGGAGA ACGTTTTAGC | |
| | | GCGCCTGCAA ATGTTGTTTC | |
| | | TTCAATTTTG AACGACGATC | |
| | | GCAAAGGCAG AAAAAATGGC | |
| | | CGGGGTTTCT ATCTTTATGG | |
| | | TCAGAAAGGG CGTAAAAGCA | |
| | | AAAAACAGGT CGATCCCGCC | |
| | | ATTTACCCGC TGATTGGCAC | |
| | | ACAAGGGCAG GGGCGAATCT | |

FIG. 7 (Cont.)

| | | | |
|---|---|---|---|
| | | CCGCACCGCA GGTTGCTGAA<br>CGGTGTGTGA TGTTGATGCT<br>GAATGAAGCA GTACGTTGTG<br>TTGATGAGCA GGTTATCCGT<br>AGCGTGCGTG ACGGGGATAT<br>TGGCGCGGTA TTTGGCATTG<br>GTTTTCCGCC ATTTCTCGGT<br>GGACCGTTCC GCTATATCGA<br>TTCTCTCGGC GCGGGCGAAG<br>TGGTTGCAAT AATGCAACGA<br>CTTGCCACGC AGTATGGTTC<br>CCGTTTTACC CCTTGCGAGC<br>GTTTGGTCGA GATGGGCGCG<br>CGTGGGGAAA GTTTTTGGAA<br>AACAACTGCA ACTGACCTGC<br>AATAA (SEQ ID NO:105) | |
| **xerC** | site-specific tyrosine recombinase | atgACCGATT TACACACCGA<br>TGTAGAACGC TACCTACGTT<br>ATCTGAGCGT GGAGCGCCAG<br>CTTAGCCCGA TAACCCTGCT<br>TAACTACCAG CGTCAGCTTG<br>AGGCGATCAT CAATTTTGCC<br>AGCGAAAACG GCCTGCAAAG<br>CTGGCAGCAA TGTGATGTGA<br>CGATGGTGCG CAATTTTGCT<br>GTACGCAGTC GCCGTAAAGG<br>GCTGGGAGCA GCAAGTCTGG<br>CGTTACGGCT TTCTGCGCTA<br>CGTAGCTTTT TTGACTGGCT<br>GGTCAGCCAG AACGAACTCA<br>AAGCTAACCC GGCGAAAGGT<br>GTTTCGGCAC CGAAAGCGCC<br>GCGTCATCTG CCGAAAAACA<br>TCGACGTCGA CGATATGAAT<br>CGGCTGCTGG ATATTGATAT<br>CAATGATCCC CTCGCTGTAC<br>GCGACCGTGC AATGCTGGAA<br>GTGATGTACG GCGCGGGTCT<br>GCGTCTTTCT GAGCTGGTGG<br>GGCTGGATAT TAAACACCTC<br>GACCTGGAGT CTGGTGAAGT<br>GTGGGTTATG GGGAAAGGCA<br>GCAAAGAGCG CCGCCTGCCG<br>ATTGGTCGCA ACGCTGTGGC<br>GTGGATTGAG CACTGGCTTG<br>ATTTGCGCGA CCTGTTTGGT<br>AGCGAAGACG ACGCGCTTTT<br>TCTGTCGAAA CTGGGCAAGC<br>GTATCTCCGC GCGTAATGTG<br>CAGAAACGCT TTGCCGAATG<br>GGGCATAAAA CAAGGGCTGA<br>ATAATCACGT TCATCCGCAT<br>AAATTACGTC ACTCGTTCGC<br>CACGCATATG CTGGAGTCGA<br>GCGGCGATCT TCGTGGTGTG | MTDLHTDVER<br>YLRYLSVERQ<br>LSPITLLNYQ<br>RQLEAIINFA<br>SENGLQSWQQ<br>CDVTMVRNFA<br>VRSRRKGLGA<br>ASLALRLSAL<br>RSFFDWLVSQ<br>NELKANPAKG<br>VSAPKAPRHL<br>PKNIDVDDMN<br>RLLDIDINDP<br>LAVRDRAMLE<br>VMYGAGLRLS<br>ELVGLDIKHL<br>DLESGEVWVM<br>GKGSKERRLP<br>IGRNAVAWIE<br>HWLDLRDLFG<br>SEDDALFLSK<br>LGKRISARNV<br>QKRFAEWGIK<br>QGLNNHVHPH<br>KLRHSFATHM<br>LESSGDLRGV<br>QELLGHANLS<br>TTQIYTHLDF<br>QHLASVYDAA HPRAKRGK<br>(SEQ ID NO:108) |

FIG. 7 (Cont.)

| | | | |
|---|---|---|---|
| | | CAGGAGCTGC TGGGTCATGC CAACCTCTCC ACCACGCAAA TCTATACTCA TCTTGATTTT CAACACCTTG CCTCGGTGTA CGATGCGGCG CATCCACGCG CCAAACGGGG GAAATAA (SEQ ID NO:107) | |
| yqeF | predicted acyltransferase | atgAAAGACG TTGTGATTGT CGGGGCGTTA CGGACACCTA TCGGCTGCTT TCGTGGTGCG TTAGCGGGTC ATTCCGCCGT GGAACTTGGT AGTCTGGTCG TGAAAGCGTT AATAGAACGT ACCGGCGTTC CTGCATATGC GGTGGATGAA GTAATTCTTG GTCAGGTGTT GACTGCCAGGG GCAGGGCAGA ATCCGGCAAG GCAATCGGCT ATTAAAGGTG GTCTGCCTAA TAGCGTTTCT GCAATCACTA TTAATGACGT TTGCGGTTCC GGGCTTAAAG CACTGCATCT GGCTACTCAG GCGATACAGT GTGGCGAGGC TGATATTGTC ATCGCCGGTG GCCAGGAAAA CATGAGCCGC GCACCACATG TTCTGACTGA TAGCCGCACC GGTGCACAGC TTGGCAATAG CCAGTTGGTT GACAGTCTTG TGCATGATGG GTTGTGGGAT GCCTTCAATG ATTATCATAT TGGTGTCACC GCCGAAAATC TGGCTCGCGA ATATGGCATC AGCCGTCAGT TGCAGGATGC TTACGCACTT AGCTCGCAAC AAAAAGCGCG AGCGGCGATT GACGCCGGAC GATTTAAAGA TGAGATCGTC CCGGTAATGA CCCAAAGTAA CGGGCAGACG TTGGTTGTTG ATACCGATGA ACAGCCACGC ACTGACGCCA GCGCAGAAGG CTTAGCCCGT TTAAATCCTT CATTTGATAG TCTCGGTTCT GTGACAGCGG GTAATGCATC ATCCATAAAC GATGGCGCAG CTGCGGTAAT GATGATGAGC GAAGCCAAAG CACGAGCGTT GAATTTACCC GTGCTGGCCC GCATTCGCGC ATTTGCCAGC GTTGGTGTAG ATCCGGCATT GATGGGAATT GCGCCGGTGT ATGCGACCCG CCGTTGCCTG GAGCGTGTAG GCTGGCAGTT GGCTGAAGTC GATCTTATCG AGGCTAATGA AGCGTTTGCT | MKDVVIVGAL RTPIGCFRGA LAGHSAVELG SLVVKALIER TGVPAYAVDE VILGQVLTAG AGQNPARQSA IKGGLPNSVS AITINDVCGS GLKALHLATQ AIQCGEADIV IAGGQENMSR APHVLTDSRT GAQLGNSQLV DSLVHDGLWD AFNDYHIGVT AENLAREYGI SRQLQDAYAL SSQQKARAAI DAGRFKDEIV PVMTQSNGQT LVVDTDEQPR TDASAEGLAR LNPSFDSLGS VTAGNASSIN DGAAAVMMMS EAKARALNLP VLARIRAFAS VGVDPALMGI APVYATRRCL ERVGWQLAEV DLIEANEAFA AQALSVGKML EWDERRVNVN GGAIALGHPI GASGCRILVS LVHEMVKRNA RKGLATLCIG GGQGVALTIE RDE (SEQ ID NO:110) |

FIG. 7 (Cont.)

| | | | |
|---|---|---|---|
| | | GCACAGGCGC TTTCGGTTGG CAAGATGCTT GAGTGGGATG AGCGTCGGGT CAATGTCAAT GGTGGCGCGA TCGCACTCGG TCACCCGATA GGCGCTTCCG GTTGCCGAAT CCTGGTTTCT CTGGTTCATG AAATGGTGAA ACGTAATGCC CGCAAAGGAC TGGCAACGCT TTGTATCGGC GGGGGCCAGG GTGTGGCATT GACCATTGAA CGTGACGAAT AG (SEQ ID NO:109) | |
| **murQ** | predicted PTS component | atgCAATTTG AAAAGATGAT TACTGAAGGC TCGAACACCG CCTCGGCTGA AATTGACCGC GTATCGACGC TGGAAATGTG CCGGATTATC AACGATGAAG ATAAAACCGT ACCGCTTGCC GTTGAGCGCG TACTGCCGGA TATCGCCGCG GCGATCGATG TTATCCACGC CCAGGTAAGC GGCGGCGGGC GTCTGATTTA CCTCGGTGCG GGAACATCCG GTCGTCTGGG GATTCTGGAT GCCAGCGAAT GTCCGCCCAC CTACGGCGTG AAACCGGGTC TGGTGGTTGG TTTGATTGCT GGCGGCGAAT ATGCCATTCA GCACGCGGTG GAAGGCGCGG AAGATAGCCG GGAAGGCGGT GTTAATGATC TGAAAAATAT TAATTTAACG GCACAGGATG TGGTGGTTGG CATTGCTGCC AGCGGTCGCA CGCCGTATGT GATTGCCGGA CTGGAATACG CACGCCAGCT CGGCTGCCGC ACAGTGGGAA TTTCCTGTAA TCCGGGGAGC GCCGTTTCAA CCACCGCTGA GTTTGCCATT ACACCGATTG TAGGTGCCGA AGTTGTTACC GGTTCTTCGC GGATGAAAGC AGGTACAGCG CAGAAACTGG TGCTCAATAT GCTTTCCACC GGGCTGATGA TTAAATCCGG CAAAGTGTTC GGCAACCTGA TGGTCGATGT GGTCGCCACC AACGAAAAAC TGCATGTGCG ACAGGTCAAT ATTGTTAAAA ACGCCACCGG ATGTAGCGCA GAGCAAGCGG AAGCGGCGTT AATTGCTTGC GAGCGCAACT GTAAAACGGC CATTGTGATG GTGCTGAAAA ATCTCGATGC CGCAGAAGCT AAAAAACGCC TGGATCAACA | MQFEKMITEG SNTASAEIDR VSTLEMCRII NDEDKTVPLA VERVLPDIAA AIDVIHAQVS GGGRLIYLGA GTSGRLGILD ASECPPTYGV KPGLVVGLIA GGEYAIQHAV EGAEDSREGG VNDLKNINLT AQDVVVGIAA SGRTPYVIAG LEYARQLGCR TVGISCNPGS AVSTTAEFAI TPIVGAEVVT GSSRMKAGTA QKLVLNMLST GLMIKSGKVF GNLMVDVVAT NEKLHVRQVN IVKNATGCSA EQAEAALIAC ERNCKTAIVM VLKNLDAAEA KKRLDQHGGF IRQVLDKE (SEQ ID NO:112) |

FIG. 7 (Cont.)

| | | | |
|---|---|---|---|
| | | CGGCGGCTTT ATTCGTCAGG TTTTAGACAA GGAATAA (SEQ ID NO:111) | |

| Source | Genbank Accession Number |
|---|---|
| Shigella boydii CDC 3083-94 | YP_001881145.1 |
| Escherichia fergusonii ATCC 35469 | YP_002382013.1 |
| Salmonella enterica subsp. arizonae | YP_001569590.1 |
| Citrobacter sp. 30_2 | ZP_04562837.1 |
| Klebsiella pneumoniae subsp. pneumoniae MGH 78578 | YP_001336360.1 |
| Pectobacterium carotovorum subsp. carotovorum WPP14 | ZP_03831287.1 |
| Enterobacter cancerogenus ATCC 35316 | ZP_03283474.1 |
| Pantoea sp. At-9b | ZP_05730617.1 |
| Cronobacter turicensis | CBA32510.1 |
| Dickeya dadantii Ech586 | ZP_05723897.1 |
| Erwinia tasmaniensis Et1/99 | YP_001907100.1 |
| Serratia proteamaculans 568 | YP_001479594.1 |
| Edwardsiella ictaluri 93-146 | YP_002934130.1 |
| Sodalis glossinidius str. 'morsitans' | YP_455303.1 |
| Yersinia aldovae ATCC 35236 | ZP_04620215.1 |

FIG. 7 (Cont.)

| | |
|---|---|
| Providencia stuartii ATCC 25827 | ZP_02961167.1 |
| Photorhabdus asymbiotica | YP_003040275.1 |
| Proteus mirabilis HI4320 | YP_002151524.1 |
| Candidatus Blochmannia pennsylvanicus str. BPEN | YP_278005.1 |
| Glaciecola sp. HTCC2999 | ZP_03561088.1 |
| Vibrio cholerae V51 | ZP_04919940.1 |
| Wigglesworthia glossinidia endosymbiont of Glossina brevipalpis | NP_871411.1 |
| Tolumonas auensis DSM 9187 | YP_002892770.1 |
| Actinobacillus pleuropneumoniae serovar 1 str. 4074 | ZP_00134992.2 |
| Aggregatibacter aphrophilus NJ8700 | YP_003007711.1 |
| Pseudoalteromonas tunicata D2 | ZP_01135065.1 |
| Vibrionales bacterium SWAT-3 | ZP_01816638.1 |
| Pasteurella multocida subsp. multocida str. Pm70 | NP_245276.1 |
| Mannheimia succiniciproducens MBEL55E | YP_088783.1 |
| Haemophilus somnus 129PT | YP_718877.1 |
| Shewanella loihica PV-4 | YP_001094535.1 |
| Aliivibrio salmonicida LFI1238 | YP_002262558.1 |
| | |

METHODS AND COMPOSITIONS FOR PRODUCING FATTY ALDEHYDES

CROSS REFERENCE TO RELATED APPLICATIONS

This application claims the benefit of U.S. Provisional Application No. 61/103,447, filed Oct. 7, 2008, the entire contents of which are hereby incorporated by reference herein.

BACKGROUND OF THE INVENTION

Petroleum is a limited, natural resource found in the Earth in liquid, gaseous, or solid forms. Petroleum is primarily composed of hydrocarbons, which are comprised mainly of carbon and hydrogen. It also contains significant amounts of other elements, such as, nitrogen, oxygen, or sulfur, in different forms.

Petroleum is a valuable resource, but petroleum products are developed at considerable costs, both financial and environmental. First, sources of petroleum must be discovered. Petroleum exploration is an expensive and risky venture. The cost of exploring deep water wells can exceed $100 million. Moreover, there is no guarantee that these wells will contain petroleum. It is estimated that only 40% of drilled wells lead to productive wells generating commercial hydrocarbons. In addition to the economic cost, petroleum exploration carries a high environmental cost. For example, offshore exploration disturbs the surrounding marine environments.

After a productive well is discovered, the petroleum must be extracted from the Earth at great expense. During primary recovery, the natural pressure underground is sufficient to extract about 20% of the petroleum in the well. As this natural pressure falls, secondary recovery methods are employed, if economical. Generally, secondary recovery involves increasing the well's pressure by, for example, water injection, natural gas injection, or gas lift. Using secondary recovery methods, an additional 5% to 15% of petroleum is recovered. Once secondary recovery methods are exhausted, tertiary recovery methods can be used, if economical. Tertiary methods involve reducing the viscosity of the petroleum to make it easier to extract. Using tertiary recovery methods, an additional 5% to 15% of petroleum is recovered. Hence, even under the best circumstances, only 50% of the petroleum in a well can be extracted. Petroleum extraction also carries an environmental cost. For example, petroleum extraction can result in large seepages of petroleum rising to the surface. Moreover, offshore drilling involves dredging the seabed which disrupts or destroys the surrounding marine environment.

Since petroleum deposits are not found uniformly throughout the Earth, petroleum must be transported over great distances from petroleum producing regions to petroleum consuming regions. In addition to the shipping costs, there is also the environmental risk of devastating oil spills.

In its natural form, crude petroleum extracted from the Earth has few commercial uses. It is a mixture of hydrocarbons (e.g., paraffins (or alkanes), olefins (or alkenes), alkynes, napthenes (or cylcoalkanes), aliphatic compounds, aromatic compounds, etc.) of varying length and complexity. In addition, crude petroleum contains other organic compounds (e.g., organic compounds containing nitrogen, oxygen, sulfur, etc.) and impurities (e.g., sulfur, salt, acid, metals, etc.).

Hence, crude petroleum must be refined and purified before it can be used commercially. Due to its high energy density and its easy transportability, most petroleum is refined into fuels, such as transportation fuels (e.g., gasoline, diesel, aviation fuel, etc.), heating oil, liquefied petroleum gas, etc.

Crude petroleum is also a primary source of raw materials for producing petrochemicals. The two main classes of raw materials derived from petroleum are short chain olefins (e.g., ethylene and propylene) and aromatics (e.g., benzene and xylene isomers). These raw materials are derived from longer chain hydrocarbons in crude petroleum by cracking it at considerable expense using a variety of methods, such as catalytic cracking, steam cracking, or catalytic reforming. These raw materials are used to make petrochemicals, which cannot be directly refined from crude petroleum, such as monomers, solvents, detergents, or adhesives.

One example of a raw material derived from crude petroleum is ethylene. Ethylene is used to produce petrochemicals, such as polyethylene, ethanol, ethylene oxide, ethylene glycol, polyester, glycol ether, ethoxylate, vinyl acetate, 1,2-dichloroethane, trichloroethylene, tetrachloroethylene, vinyl chloride, and polyvinyl chloride. An additional example of a raw material is propylene, which is used to produce isopropyl alcohol, acrylonitrile, polypropylene, propylene oxide, propylene glycol, glycol ethers, butylene, isobutylene, 1,3-butadiene, synthetic elastomers, polyolefins, alpha-olefins, fatty alcohols, acrylic acid, acrylic polymers, allyl chloride, epichlorohydrin, and epoxy resins.

These petrochemicals can then be used to make specialty chemicals, such as plastics, resins, fibers, elastomers, pharmaceuticals, lubricants, or gels. Particular specialty chemicals that can be produced from petrochemical raw materials are fatty acids, hydrocarbons (e.g., long chain, branched chain, saturated, unsaturated, etc.), fatty alcohols, esters, fatty aldehydes, ketones, lubricants, etc.

Aldehydes are used to produce many specialty chemicals. For example, aldehydes are used to produce polymers, resins (e.g., Bakelite), dyes, flavorings, plasticizers, perfumes, pharmaceuticals, and other chemicals. Some are used as solvents, preservatives, or disinfectants. Some natural and synthetic compounds, such as vitamins and hormones, are aldehydes. In addition, many sugars contain aldehyde groups.

Obtaining these specialty chemicals from crude petroleum requires a significant financial investment as well as a great deal of energy. It is also an inefficient process because frequently the long chain hydrocarbons in crude petroleum are cracked to produce smaller monomers. These monomers are then used as the raw material to manufacture the more complex specialty chemicals.

In addition to the problems with exploring, extracting, transporting, and refining petroleum, petroleum is a limited and dwindling resource. One estimate of world petroleum consumption is 30 billion barrels per year. By some estimates, it is predicted that at current production levels, the world's petroleum reserves could be depleted before the year 2050.

Finally, the burning of petroleum based fuels releases greenhouse gases (e.g., carbon dioxide) and other forms of air pollution (e.g., carbon monoxide, sulfur dioxide, etc.). As the world's demand for fuel increases, the emission of greenhouse gases and other forms of air pollution also increases. The accumulation of greenhouse gases in the atmosphere can lead to an increase global warming. Hence, in addition to damaging the environment locally (e.g., oil spills, dredging of marine environments, etc.), burning petroleum also damages the environment globally.

Due to the inherent challenges posed by petroleum, there is a need for a renewable petroleum source that does not need to be explored, extracted, transported over long distances, or substantially refined like petroleum. There is also a need for a renewable petroleum source which can be produced economically without creating the type of environmental damage produced by the petroleum industry and the burning of petroleum based fuels. For similar reasons, there is also a need for a renewable source of chemicals which are typically derived from petroleum.

One method of producing renewable petroleum is by engineering microorganisms to produce renewable petroleum products. Some microorganisms have a natural ability to produce chemicals. For example, yeast has been used for centuries to produce ethanol (e.g., beer, wine, etc.). In recent years, through the development of advanced biotechnologies, it is possible to metabolically engineer an organism to produce bioproducts that were never previously produced. Products, such as chemicals, derived from these cellular activities are known as bioproducts. Fuels produced these cellular activities are known as biofuels. Biofuels are a renewable alternative fuel to petroleum based fuels. Biofuels can be substituted for any petroleum based fuel (e.g., gasoline, diesel, aviation fuel, heating oil, etc.). Biofuels can be derived from renewable sources, such as plant matter, animal matter, or even waste products. These renewable sources are collectively known as biomass. One advantage of biofuels over petroleum based fuels is that they do not require expensive and risky exploration or extraction. In addition, biofuels can be locally produced. Hence, they do not require transportation over long distances. Moreover, biofuels can be made directly without the need for expensive and energy intensive refining as is needed with refining crude petroleum. In other circumstances, the biofuel may require a limited and cost-effective level of refining. Furthermore, the use of biofuels improves the environment by reducing the amount of environmentally harmful emissions (e.g., green house gases, air pollution, etc.) released during combustion. For example, biofuels maintain a balanced carbon cycle because biofuels are produced from biomass, a renewable, natural resource. While the burning of biofuels will release carbon (e.g., as carbon dioxide), this carbon will be recycled during the production of biomass (e.g., the cultivation of crops), thereby balancing the carbon cycle unlike petroleum based fuels.

For similar reasons, biologically derived chemicals offer the same advantages as biofuels over petroleum based fuels. Biologically derived chemicals are a renewable alternative to petrochemicals. Biologically derived chemicals, such as hydrocarbons (e.g., alkanes, alkenes, or alkynes), fatty alcohols, esters, fatty acids, fatty aldehydes, and ketones are superior to petrochemicals because they are produced directly without extensive refining. Unlike petrochemicals, biologically derived chemicals do not need to be refined like crude petroleum to recover raw materials which must then be further processed to make more complex petrochemicals. Biologically derived chemicals are directly converted from biomass to the desired chemical product.

SUMMARY OF THE INVENTION

The invention is based, at least in part, on the identification of genes that encode fatty aldehyde biosynthetic polypeptides. Accordingly, in one aspect, the invention features a method of making a fatty aldehyde. The method includes expressing in a host cell a gene encoding a fatty aldehyde biosynthetic polypeptide comprising the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122, or a variant thereof. In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the fatty aldehyde biosynthetic polypeptide comprises the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122, with one or more amino acid substitutions, additions, insertions, or deletions, and the polypeptide has carboxylic acid reductase activity. In some embodiments, the polypeptide has fatty acid reductase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide has carboxylic acid reductase activity. In some embodiments, the polypeptide has fatty acid reductase activity.

In some embodiments, the method further includes culturing the host cell in the presence of at least one biological substrate for the fatty aldehyde biosynthetic polypeptide.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the polypeptide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum*, and *Mycobacterium ulcerans*. In other embodiments, the bacterium is *Nocardia* sp. NRRL 5646, *Nocardia farcinica, Streptomyces griseus, Salinispora arenicola*, or *Clavibacter michiganenesis.*

In some embodiments, the method further includes culturing the host cell in the presence of at least one biological substrate for the fatty aldehyde biosynthetic polypeptide.

In another aspect, the invention features a method of producing a fatty aldehyde. The method includes expressing in a host cell a gene encoding a fatty aldehyde biosynthetic polypeptide comprising an amino acid sequence having at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122. In some embodiments, the amino acid sequence is the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the polypeptide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum*, and *Mycobacterium ulcerans*. In other embodiments, the bacterium is *Nocardia* sp. NRRL 5646, *Nocardia farcinica, Streptomyces griseus, Salinispora arenicola*, or *Clavibacter michiganenesis.*

In some embodiments, the method further includes culturing the host cell in the presence of at least one biological substrate for the fatty aldehyde biosynthetic polypeptide.

In another aspect, the invention features a method of producing a fatty aldehyde. The method includes expressing in a host cell a polynucleotide that hybridizes to a complement of the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121, or to a fragment thereof, wherein the polynucleotide encodes a polypeptide having carboxylic acid reductase activity. In some embodiments, the polypeptide has fatty acid reductase activity.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the polynucleotide hybridizes under low stringency, medium stringency, high stringency, or very high stringency conditions, to a complement of the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121, or to a fragment thereof.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the polynucleotide is from a bacterium, a plant, an insect, a yeast, a fungus, or a mammal.

In certain embodiments, the polypeptide is from a mammalian cell, plant cell, insect cell, yeast cell, fungus cell, filamentous fungi cell, bacterial cell, or any other organism described herein. In some embodiments, the bacterium is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum*, and *Mycobacterium ulcerans*. In other embodiments, the bacterium is *Nocardia* sp. NRRL 5646, *Nocardia farcinica, Streptomyces griseus, Salinispora arenicola*, or *Clavibacter michiganenesis.*

In some embodiments, the method further includes culturing the host cell in the presence of at least one biological substrate for the fatty aldehyde biosynthetic polypeptide.

In another aspect, the invention features a method of producing a fatty aldehyde. The method comprises (i) expressing in a host cell a gene encoding a fatty aldehyde biosynthetic polypeptide comprising the amino acid of SEQ ID NO:16, or a variant thereof, and (ii) modifying the expression of a gene encoding a fatty acid synthase includes expressing a gene encoding a fatty acid synthase in the host cell and/or increasing the expression or activity of an endogenous fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the polypeptide comprises the amino acid sequence of SEQ ID NO:16 with one or more amino acid substitutions, additions, insertions, or deletions, wherein the polypeptide has carboxylic acid reductase activity. In some embodiments, the polypeptide has fatty acid reductase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide has carboxylic acid reductase activity. In some embodiments, the polypeptide has fatty acid reductase activity.

In some embodiments, the method further includes culturing the host cell in the presence of at least one biological substrate for the fatty aldehyde biosynthetic polypeptide.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In another aspect, the invention features a method of producing a fatty aldehyde. The method includes (i) expressing in a host cell a gene encoding a fatty aldehyde biosynthetic polypeptide comprising an amino acid sequence having at least about 70% sequence identity to the amino acid sequence of SEQ ID NO:16, and (ii) modifying the expression of a gene encoding a fatty acid synthase includes expressing a gene encoding a fatty acid synthase in the host cell and/or increasing the expression or activity of an endogenous fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the amino acid sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the amino acid sequence of SEQ ID NO:16. In some embodiments, the amino acid sequence is SEQ ID NO:16.

In some embodiments, the method further includes culturing the host cell in the presence of at least one biological substrate for the fatty aldehyde biosynthetic polypeptide.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In another aspect, the invention features a method of producing a fatty aldehyde. The method includes (i) expressing in a host cell a polynucleotide that hybridizes to a complement of the nucleotide sequence of SEQ ID NO:15, or to a fragment thereof, wherein the polynucleotide encodes a polypeptide having carboxylic acid reductase activity; and (ii) modifying the expression of a gene encoding a fatty acid synthase includes expressing a gene encoding a fatty acid synthase in the host cell and/or increasing the expression or activity of an endogenous fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1. In some embodiments, the polypeptide has fatty acid reductase activity.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the polynucleotide hybridizes under low stringency, medium stringency, high stringency, or very high stringency conditions, to a complement of the nucleotide sequence of SEQ ID NO:15, or to a fragment thereof.

In some embodiments, the method further includes culturing the host cell in the presence of at least one biological substrate for the fatty aldehyde biosynthetic polypeptide.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In another aspect, the invention features a method of producing a fatty aldehyde. The method includes expressing in a host cell a gene encoding a fatty aldehyde biosynthetic polypeptide comprising the amino acid of SEQ ID NO:16, or a variant thereof, wherein the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the polypeptide comprises the amino acid sequence of SEQ ID NO:16 with one or more amino acid substitutions, additions, insertions, or deletions, wherein the polypeptide has carboxylic acid reductase activity. In some embodiments, the polypeptide has fatty acid reductase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the method further includes culturing the host cell in the presence of at least one biological substrate for the fatty aldehyde biosynthetic polypeptide.

In another aspect, the invention features a method of producing a fatty aldehyde. The method includes expressing in a host cell a gene encoding a fatty aldehyde biosynthetic polypeptide comprising an amino acid sequence having at least about 70% sequence identity to the amino acid sequence of SEQ ID NO:16, wherein the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the amino acid sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the amino acid sequence of SEQ ID NO:16. In some embodiments, the amino acid sequence is SEQ ID NO:16.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the method further includes culturing the host cell in the presence of at least one biological substrate for the fatty aldehyde biosynthetic polypeptide.

In another aspect, the invention features a method of producing a fatty aldehyde. The method includes expressing in a host cell a polynucleotide that hybridizes to a complement of the nucleotide sequence of SEQ ID NO:15, or to a fragment thereof, wherein the polynucleotide encodes a polypeptide having carboxylic acid reductase activity, and wherein the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the polynucleotide hybridizes under low stringency, medium stringency, high stringency, or very high stringency conditions, to a complement of the nucleotide sequence of SEQ ID NO:15, or to a fragment thereof.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the method further includes culturing the host cell in the presence of at least one biological substrate for the fatty aldehyde biosynthetic polypeptide.

In another aspect, the invention features a method of producing a fatty aldehyde. The method includes expressing in a host cell a recombinant vector comprising a fatty aldehyde biosynthetic nucleotide sequence having at least about 70% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121. In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121. In some embodiments, the nucleotide sequence is the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the recombinant vector further comprises a promoter operably linked to the nucleotide sequence. In certain embodiments, the promoter is a developmentally-regulated, an organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses a polypeptide encoded by the recombinant vector. In some embodiments, the nucleotide sequence is stably incorporated into the genomic DNA of the host cell, and the expression of the nucleotide sequence is under the control of a regulated promoter region.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the method further includes culturing the host cell in the presence of at least one biological substrate for a fatty aldehyde biosynthetic polypeptide.

In another aspect, the invention features a method of producing a fatty aldehyde. The method includes (i) expressing in a host cell a recombinant vector comprising a fatty aldehyde biosynthetic nucleotide sequence having at least about 70% sequence identity to the nucleotide sequence of SEQ ID NO:15, and (ii) modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:15. In some embodiments, the nucleotide sequence is the nucleotide sequence of SEQ ID NO:15.

In some embodiments, the recombinant vector further comprises a promoter operably linked to the nucleotide sequence. In certain embodiments, the promoter is a developmentally-regulated, an organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses a polypeptide encoded by the recombinant vector. In some embodiments, the nucleotide sequence is stably incorporated into the genomic DNA of the host cell, and the expression of the nucleotide sequence is under the control of a regulated promoter region.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the method further includes culturing the host cell in the presence of at least one biological substrate for a fatty aldehyde biosynthetic polypeptide.

In another aspect, the invention features a method of producing a fatty aldehyde. The method includes expressing in a host cell a recombinant vector comprising a fatty aldehyde biosynthetic nucleotide sequence having at least about 70% sequence identity to the nucleotide sequence of SEQ ID NO:15, wherein the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:15. In some embodiments, the nucleotide sequence is the nucleotide sequence of SEQ ID NO:15.

In some embodiments, the recombinant vector further comprises a promoter operably linked to the nucleotide sequence. In certain embodiments, the promoter is a developmentally-regulated, an organelle-specific, a tissue-specific, an inducible, a constitutive, or a cell-specific promoter.

In other embodiments, the recombinant vector comprises at least one sequence selected from the group consisting of (a) a regulatory sequence operatively coupled to the nucleotide sequence; (b) a selection marker operatively coupled to the nucleotide sequence; (c) a marker sequence operatively coupled to the nucleotide sequence; (d) a purification moiety operatively coupled to the nucleotide sequence; (e) a secretion sequence operatively coupled to the nucleotide sequence; and (f) a targeting sequence operatively coupled to the nucleotide sequence.

In some embodiments, the recombinant vector is a plasmid.

In some embodiments, the host cell expresses a polypeptide encoded by the recombinant vector. In some embodiments, the nucleotide sequence is stably incorporated into the genomic DNA of the host cell, and the expression of the nucleotide sequence is under the control of a regulated promoter region.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the method further includes culturing the host cell in the presence of at least one biological substrate for a fatty aldehyde biosynthetic polypeptide.

In another aspect, the invention features a method of producing a fatty aldehyde. The method includes expressing in a host cell a gene encoding a fatty aldehyde biosynthetic polypeptide comprising (i) SEQ ID NO:7, SEQ ID NO:8, SEQ ID NO:9, and SEQ ID NO:10; (ii) SEQ ID NO:11, SEQ ID NO:12, SEQ ID NO:13, or SEQ ID NO:14; and/or (iii) SEQ ID NO:7, SEQ ID NO:9, SEQ ID NO:10, and SEQ ID NO:11; wherein the polypeptide has carboxylic acid reductase activity. In some embodiments, the polypeptide has fatty acid reductase activity.

In some embodiments, the method further includes isolating the fatty aldehyde from the host cell. In some embodiments, the fatty aldehyde is present in the extracellular environment. In certain embodiments, the fatty aldehyde is isolated from the extracellular environment of the host cell. In some embodiments, the fatty aldehyde is secreted from the host cell. In alternative embodiments, the fatty aldehyde is transported into the extracellular environment. In other embodiments, the fatty aldehyde is passively transported into the extracellular environment.

In some embodiments, the polypeptide is about 1,000 amino acids to about 2,000 amino acids in length. In certain embodiments, the polypeptide is about 1,000 amino acids in length, about 1,050 amino acids in length, about 1,100 amino acids in length, about 1,150 amino acids in length, about 1,200 amino acids in length, about 1,250 amino acids in length, about 1,300 amino acids in length, about 1,400 amino acids in length, about 1,500 amino acids in length, about 1,600 amino acids in length, about 1,700 amino acids in length, about 1,800 amino acids in length, about 1,900 amino acids in length, or about 2,000 amino acids in length. In other embodiments, the polypeptide is up to about 1,500 amino acids in length, up to about 1,400 amino acids in length, up to about 1,300 amino acids in length, up to about 1,250 amino acids in length, up to about 1,200 amino acids in length, up to about 1,150 amino acids in length, up to about 1,100 amino acids in length, up to about 1,050 amino acids in length, or up to about 1,000 amino acids in length.

In some embodiments, the method further includes modifying the expression of a gene encoding a fatty acid synthase in the host cell. In certain embodiments, modifying the expression of a gene encoding a fatty acid synthase includes expressing a gene encoding a fatty acid synthase in the host cell and/or increasing the expression or activity of an endogenous fatty acid synthase in the host cell. In alternate embodiments, modifying the expression of a gene encoding a fatty acid synthase includes attenuating a gene encoding a fatty acid synthase in the host cell and/or decreasing the expression or activity of an endogenous fatty acid synthase in the host cell. In some embodiments, the fatty acid synthase is a thioesterase. In particular embodiments, the thioesterase is encoded by tesA, tesA without leader sequence, tesB, fatB, fatB2, fatB3, fatA, or fatA1.

In other embodiments, the host cell is genetically engineered to express an attenuated level of a fatty acid degradation enzyme relative to a wild type host cell. In some embodiments, the host cell is genetically engineered to express an attenuated level of an acyl-CoA synthase relative to a wild type host cell. In particular embodiments, the host cell expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the genetically engineered host cell comprises a knockout of one or more genes encoding a fatty acid degradation enzyme, such as the aforementioned acyl-CoA synthase genes.

In yet other embodiments, the host cell is genetically engineered to express an attenuated level of a dehydratase/isomerase enzyme, such as an enzyme encoded by fabA or by a gene listed in FIG. 6. In some embodiments, the host cell comprises a knockout of fabA or a gene listed in FIG. 6. In other embodiments, the host cell is genetically engineered to express an attenuated level of a ketoacyl-ACP synthase, such as an enzyme encoded by fabB or by a gene listed in FIG. 7. In other embodiments, the host cell comprises a knockout of fabB or a gene listed in FIG. 7. In yet other embodiments, the host cell is genetically engineered to express a modified level of a gene encoding a desaturase enzyme, such as desA.

In some embodiments, the method further includes culturing the host cell in the presence of at least one biological substrate for the fatty aldehyde biosynthetic polypeptide.

In any of the aspects of the invention described herein, the host cell can be selected from the group consisting of a mammalian cell, plant cell, insect cell, yeast cell, fungus cell, filamentous fungi cell, and bacterial cell.

In some embodiments, the host cell is a Gram-positive bacterial cell. In other embodiments, the host cell is a Gram-negative bacterial cell.

In some embodiments, the host cell is selected from the genus *Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Stenotrophamonas, Schizosaccharomyces, Yarrowia*, or *Streptomyces.*

In certain embodiments, the host cell is a *Bacillus lentus* cell, a *Bacillus brevis* cell, a *Bacillus stearothermophilus* cell, a *Bacillus licheniformis* cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus megaterium* cell, a *Bacillus subtilis* cell, or a *Bacillus amyloliquefaciens* cell.

In other embodiments, the host cell is a *Trichoderma koningii* cell, a *Trichoderma viride* cell, a *Trichoderma reesei* cell, a *Trichoderma longibrachiatum* cell, an *Aspergillus awamori* cell, an *Aspergillus fumigates* cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhodococcus opacus* cell, a *Rhizomucor miehei* cell, or a *Mucor michei* cell.

In yet other embodiments, the host cell is a *Streptomyces lividans* cell or a *Streptomyces murinus* cell.

In yet other embodiments, the host cell is an *Actinomycetes* cell.

In some embodiments, the host cell is a *Saccharomyces cerevisiae* cell. In particular embodiments, the host cell is a cell from an eukaryotic plant, algae, cyanobacterium, green-sulfur bacterium, green non-sulfur bacterium, purple sulfur bacterium, purple non-sulfur bacterium, extremophile, yeast, fungus, engineered organisms thereof, or a synthetic organism. In some embodiments, the host cell is light dependent or fixes carbon. In some embodiments, the host cell is light dependent or fixes carbon. In some embodiments, the host cell has autotrophic activity. In some embodiments, the host cell has photoautotrophic activity, such as in the presence of light. In some embodiments, the host cell is heterotrophic or mixotrophic in the absence of light. In certain embodiments, the host cell is a cell from *Avabidopsis thaliana, Panicum virgatum, Miscanthus giganteus, Zea mays, Botryococcuse braunii, Chlamydomonas reinhardtii, Dunaliela salina, Synechococcus* Sp. PCC 7002, *Synechococcus* Sp. PCC 7942, *Synechocystis* Sp. PCC 6803, *Thermosynechococcus elongates* BP-1, *Chlorobium tepidum, Chloroflexus auranticus, Chromatiumm vinosum, Rhodospirillum rubrum, Rhodobacter capsulatus, Rhodopseudomonas palusris, Clostridium ljungdahlii, Clostridiuthermocellum, Penicillium chrysogenum, Pichia pastoris, Saccharomyces cerevisiae, Schizosaccharomyces pombe, Pseudomonas fluorescens*, or *Zymomonas mobilis.*

In other embodiments, the host cell is a CHO cell, a COS cell, a VERO cell, a BHK cell, a HeLa cell, a Cv1 cell, an MDCK cell, a 293 cell, a 3T3 cell, or a PC12 cell.

In yet other embodiments, the host cell is an *E. coli* cell. In certain embodiments, the *E. coli* cell is a strain B, a strain C, a strain K, or a strain W *E. coli* cell.

In another aspect, the invention features a method of producing a fatty aldehyde. The method includes contacting a substrate with (i) a fatty aldehyde biosynthetic polypeptide comprising the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122, or a variant thereof, or (ii) a fatty aldehyde biosynthetic polypeptide encoded by a nucleotide sequence having at least about 70% identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121, or a variant thereof. In some embodiments, the method further includes purifying the fatty aldehyde.

In some embodiments, the fatty aldehyde biosynthetic polypeptide comprises the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122, with one or more amino acid substitutions, additions, insertions, or deletions, wherein the polypeptide has carboxylic acid reductase activity. In some embodiments, the polypeptide has fatty acid reductase activity.

In some embodiments, the polypeptide comprises one or more of the following conservative amino acid substitutions: replacement of an aliphatic amino acid, such as alanine, valine, leucine, and isoleucine, with another aliphatic amino acid; replacement of a serine with a threonine; replacement of a threonine with a serine; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue. In some embodiments, the polypeptide has about 1, 2, 3, 4, 5, 6, 7, 8, 9, 10, 15, 20, 30, 40, 50, 60, 70, 80, 90, 100, or more amino acid substitutions, additions, insertions, or deletions. In some embodiments, the polypeptide has carboxylic acid reductase activity. In some embodiments, the polypeptide has fatty acid reductase activity.

In some embodiments, the polypeptide has an amino acid sequence that is at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% identical to the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122. In some embodiments, the polypeptide has the amino acid sequence of SEQ ID NO:18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 114, 116, 118, 120, or 122.

In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121. In some embodiments, the nucleotide sequence is SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121.

In another aspect, the invention features a method of producing a fatty aldehyde. The method includes contacting a substrate with a fatty aldehyde biosynthetic polypeptide comprising (i) SEQ ID NO:7, SEQ ID NO:8, SEQ ID NO:9, and SEQ ID NO:10; (ii) SEQ ID NO:11, SEQ ID NO:12, SEQ ID NO:13, or SEQ ID NO:14; and/or (iii) SEQ ID NO:7, SEQ ID NO:9, SEQ ID NO:10, and SEQ ID NO:11; wherein the polypeptide has carboxylic acid reductase activity. In some embodiments, the polypeptide has fatty acid reductase activity.

In some embodiments, the polypeptide is about 1,000 amino acids to about 2,000 amino acids in length. In certain embodiments, the polypeptide is about 1,000 amino acids in length, about 1,050 amino acids in length, about 1,100 amino acids in length, about 1,150 amino acids in length, about 1,200 amino acids in length, about 1,250 amino acids in length, about 1,300 amino acids in length, about 1,400 amino acids in length, about 1,500 amino acids in length, about 1,600 amino acids in length, about 1,700 amino acids in length, about 1,800 amino acids in length, about 1,900 amino acids in length, or about 2,000 amino acids in length. In other embodiments, the polypeptide is up to about 1,500 amino acids in length, up to about 1,400 amino acids in length, up to about 1,300 amino acids in length, up to about 1,250 amino acids in length, up to about 1,200 amino acids in length, up to about 1,150 amino acids in length, up to about 1,100 amino acids in length, up to about 1,050 amino acids in length, or up to about 1,000 amino acids in length.

In any of the aspects of the invention described herein, the methods can produce fatty aldehydes comprising a $C_6$-$C_{26}$ fatty aldehyde. In some embodiments, the fatty aldehyde comprises a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{21}$, $C_{22}$, $C_{23}$, $C_{24}$, $C_{25}$, or a $C_{26}$ fatty aldehyde. In particular embodiments, the fatty aldehyde is decanal, dodecanal, myristal, or hexadecal.

In other embodiments, the fatty aldehyde comprises a straight chain fatty aldehyde. In other embodiments, the fatty aldehyde comprises a branched chain fatty aldehyde. In yet other embodiments, the fatty aldehyde comprises a cyclic moiety.

In some embodiments, the fatty aldehyde is an unsaturated fatty aldehyde. In other embodiments, the fatty aldehyde is a monounsaturated fatty aldehyde. In yet other embodiments, the fatty aldehyde is a saturated fatty aldehyde.

In any of the aspects of the invention described herein, a substrate for a fatty aldehyde biosynthetic polypeptide can be a fatty acid. In some embodiments, the fatty acid comprises a $C_6$-$C_{26}$ fatty acid. In some embodiments, the fatty acid comprises a $C_6$, $C_7$, $C_8$, $C_9$, $C_{10}$, $C_{11}$, $C_{12}$, $C_{13}$, $C_{14}$, $C_{15}$, $C_{16}$, $C_{17}$, $C_{18}$, $C_{19}$, $C_{20}$, $C_{21}$, $C_{22}$, $C_{23}$, $C_{24}$, $C_{25}$, or a $C_{26}$ fatty acid. In particular embodiments, the fatty acid is a $C_6$, $C_8$, $C_{10}$, $C_{12}$, $C_{13}$, $C_{14}$, $C_{15}$, $C_{16}$, $C_{17}$, or $C_{18}$ fatty acid.

In other embodiments, the fatty acid comprises a straight chain fatty acid. In other embodiments, the fatty acid comprises a branched chain fatty acid. In yet other embodiments, the fatty acid comprises a cyclic moiety.

In some embodiments, the fatty aldehyde is an unsaturated fatty aldehyde. In other embodiments, the fatty aldehyde is a monounsaturated fatty aldehyde. In certain embodiments, the unsaturated fatty aldehyde is a C6:1, C7:1, C8:1, C9:1, C10:1, C11:1, C12:1, C13:1, C14:1, C15:1, C16:1, C17:1, C18:1, C19:1, C20:1, C21:1, C22:1, C23:1, C24:1, C25:1, or a C26:1 unsaturated fatty aldehyde. In yet other embodiments, the fatty aldehyde is unsaturated at the omega-7 position. In certain embodiments, the unsaturated fatty aldehyde comprises a cis double bond.

In another aspect, the invention features a genetically engineered microorganism comprising an exogenous control sequence stably incorporated into the genomic DNA of the microorganism upstream of a polynucleotide comprising a nucleotide sequence having at least about 70% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121, wherein the microorganism produces an increased level of a fatty aldehyde relative to a wild-type microorganism.

In some embodiments, the nucleotide sequence has at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% sequence identity to the nucleotide sequence of SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121. In some embodiments, the nucleotide sequence is SEQ ID NO:17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 113, 115, 117, 119, or 121.

In some embodiments, the polynucleotide is endogenous to the microorganism.

In other embodiments, the microorganism is genetically engineered to express a modified level of a gene encoding a fatty acid synthase in the host cell. In certain embodiments, the microorganism expresses a gene encoding a fatty acid synthase and/or has an increased expression or activity of an endogenous fatty acid synthase. In alternate embodiments, the microorganism has attenuated expression of a gene encoding a fatty acid synthase in the host cell and/or has a decreased expression or activity of an endogenous fatty acid synthase. In some embodiments, the fatty acid synthase is a thioesterase. In particular embodiments, the thioesterase is encoded by tesA, tesA without leader sequence, tesB, fatB, fatB2, fatB3, fatA, or fatA1.

In other embodiments, the microorganism is genetically engineered to express an attenuated level of a fatty acid degradation enzyme relative to a wild type microorganism. In some embodiments, the microorganism expresses an attenuated level of an acyl-CoA synthase relative to a wild type microorganism. In particular embodiments, the microorganism expresses an attenuated level of an acyl-CoA synthase encoded by fadD, fadK, BH3103, yhfL, Pfl-4354, EAV15023, fadD1, fadD2, RPC_4074, fadDD35, fadDD22, faa3p or the gene encoding the protein ZP_01644857. In certain embodiments, the microorganism comprises a knockout of one or more genes encoding a fatty acid degradation enzyme, such as the aforementioned acyl-CoA synthase genes.

In yet other embodiments, the microorganism is genetically engineered to express an attenuated level of a dehydratase/isomerase enzyme, such as an enzyme encoded by fabA or by a gene listed in FIG. 6. In some embodiments, the microorganism comprises a knockout of fabA or a gene listed in FIG. 6. In other embodiments, the microorganism is genetically engineered to express an attenuated level of a ketoacyl-ACP synthase, such as an enzyme encoded by fabB or by a gene listed in FIG. 7. In other embodiments, the microorganism comprises a knockout of fabB or a gene listed in FIG. 7.

In yet other embodiments, the microorganism is genetically engineered to express a modified level of a gene encoding a desaturase enzyme, such as desA.

In some embodiments, the microorganism is a bacterium. In certain embodiments, the bacterium is a Gram-negative or a Gram-positive bacterium.

In some embodiments, the microorganism is a mycobacterium selected from the group consisting of *Mycobacterium smegmatis, Mycobacterium abscessus, Mycobacterium avium, Mycobacterium bovis, Mycobacterium tuberculosis, Mycobacterium leprae, Mycobacterium marinum*, and *Mycobacterium ulcerans.*

In other embodiments, the microorganism is *Nocardia* sp. NRRL 5646, *Nocardia farcinica, Streptomyces griseus, Salinispora arenicola*, or *Clavibacter michiganenesis.*

In another aspect, the invention features a fatty aldehyde produced by any of the methods or any of the microorganisms described herein.

In some embodiments, the fatty aldehyde has a $\delta^{13}C$ of about −15.4 or greater. In certain embodiments, the fatty aldehyde has a $\delta^{13}C$ of about −15.4 to about −10.9, or of about −13.92 to about −13.84.

In some embodiments, the fatty aldehyde has an $f_M{}^{14}C$ of at least about 1.003. In certain embodiments, the fatty aldehyde has an $f_M{}^{14}C$ of at least about 1.01 or at least about 1.5. In some embodiments, the fatty aldehyde has an $f_M{}^{14}C$ of about 1.111 to about 1.124.

In any of the aspects described herein, a fatty aldehyde is produced at a yield of about 25 mg/L, about 50 mg/L, about 75 mg/L, about 100 mg/L, about 125 mg/L, about 150 mg/L, about 175 mg/L, about 200 mg/L, about 225 mg/L, about 250 mg/L, about 275 mg/L, about 300 mg/L, about 325 mg/L, about 350 mg/L, about 375 mg/L, about 400 mg/L, about 425 mg/L, about 450 mg/L, about 475 mg/L, about 500 mg/L, about 525 mg/L, about 550 mg/L, about 575 mg/L, about 600 mg/L, about 625 mg/L, about 650 mg/L, about 675 mg/L, about 700 mg/L, about 725 mg/L, about 750 mg/L, about 775 mg/L, about 800 mg/L, about 825 mg/L, about 850 mg/L, about 875 mg/L, about 900 mg/L, about 925 mg/L, about 950 mg/L, about 975 mg/L, about 1000 g/L, about 1050 mg/L, about 1075 mg/L, about 1100 mg/L, about 1125 mg/L, about 1150 mg/L, about 1175 mg/L, about 1200 mg/L, about 1225 mg/L, about 1250 mg/L, about 1275 mg/L, about 1300 mg/L, about 1325 mg/L, about 1350 mg/L, about 1375 mg/L, about 1400 mg/L, about 1425 mg/L, about 1450 mg/L, about 1475 mg/L, about 1500 mg/L, about 1525 mg/L, about 1550 mg/L, about 1575 mg/L, about 1600 mg/L, about 1625 mg/L, about 1650 mg/L, about 1675 mg/L, about 1700 mg/L, about 1725 mg/L, about 1750 mg/L, about 1775 mg/L, about 1800 mg/L, about 1825 mg/L, about 1850 mg/L, about 1875 mg/L, about 1900 mg/L, about 1925 mg/L, about 1950 mg/L, about 1975 mg/L, about 2000 mg/L, or more.

In any of the aspects described herein, a fatty aldehyde is produced in a host cell or a microorganism described herein from a carbon source.

The following figures are presented for the purpose of illustration only, and are not intended to be limiting.

BRIEF DESCRIPTION OF THE DRAWINGS

FIG. 2 is a listing of the nucleotide sequence and the corresponding amino acid sequence of *Nocardia* sp. NRRL 5646 car gene.

FIG. 3 is a listing of amino acid sequence motifs for CAR homologs.

FIG. 4 is a listing of nucleotide and amino acid sequences of car homolog genes.

FIG. 5 is a table identifying exemplary genes that can be expressed, overexpressed, or attenuated to increase production of particular substrates.

FIG. 6 is a table of nucleotide and amino acid sequences for fabA related genes.

FIG. 7 is a table of nucleotide and amino acid sequences for fabB related genes.

DETAILED DESCRIPTION OF THE INVENTION

Figure 1:
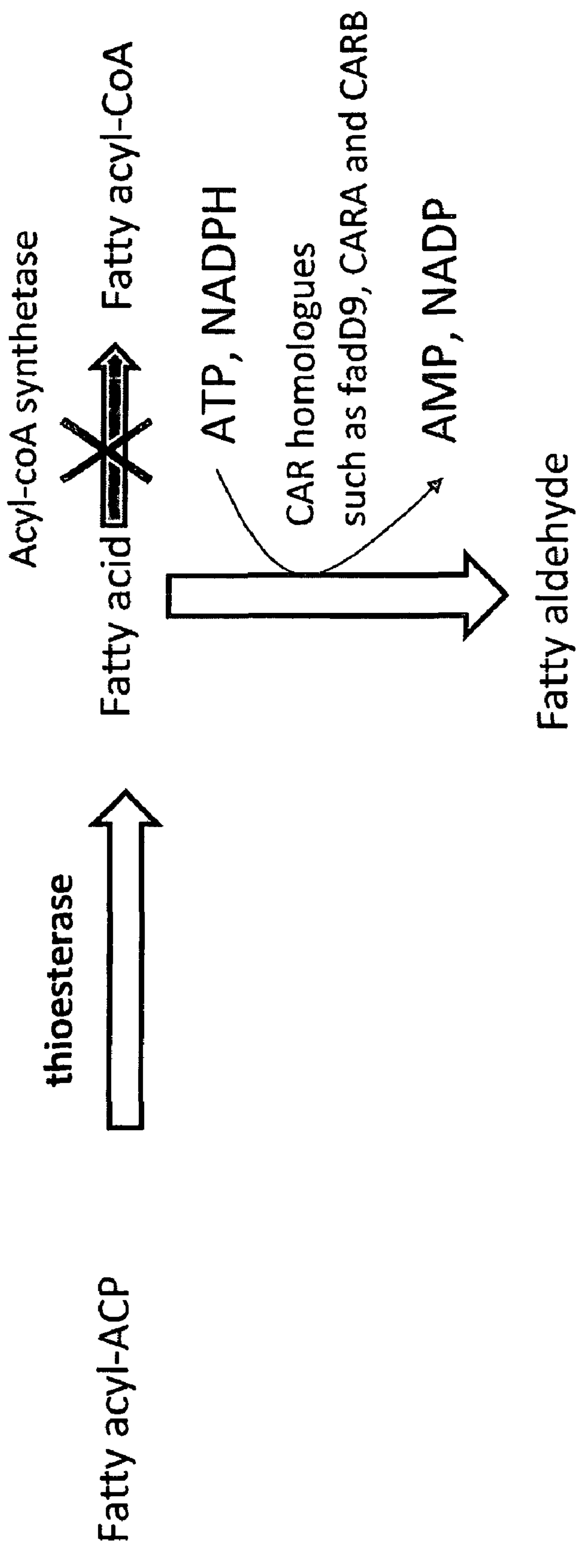
FIG. 1 is a schematic of a new pathway for fatty aldehyde production.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein, including GenBank database sequences, are incorporated by reference in their entirety. In case of conflict, the present specification, including definitions, will control. In addition, the materials, methods, and examples are illustrative only and not intended to be limiting.

Other features and advantages of the invention will be apparent from the following detailed description, and from the claims.

DEFINITIONS

Throughout the specification, a reference may be made using an abbreviated gene name or polypeptide name, but it is understood that such an abbreviated gene or polypeptide name represents the genus of genes or polypeptides. Such gene names include all genes encoding the same polypeptide and homologous polypeptides having the same physiological function. Polypeptide names include all polypeptides that have the same activity (e.g., that catalyze the same fundamental chemical reaction).

Unless otherwise indicated, the accession numbers referenced herein are derived from the NCBI database (National Center for Biotechnology Information) maintained by the National Institute of Health, U.S.A. Unless otherwise indicated, the accession numbers are as provided in the database as of October 2008.

EC numbers are established by the Nomenclature Committee of the International Union of Biochemistry and Molecular Biology (NC-IUBMB) (available at http://www.chem.qmul.ac.uk/iubmb/enzyme/). The EC numbers referenced herein are derived from the KEGG Ligand database, maintained by the Kyoto Encyclopedia of Genes and Genomics, sponsored in part by the University of Tokyo. Unless otherwise indicated, the EC numbers are as provided in the database as of October 2008.

The articles "a" and "an" are used herein to refer to one or to more than one (i.e., to at least one) of the grammatical object of the article. By way of example, "an element" means one element or more than one element.

The term "about" is used herein to mean a value ±20% of a given numerical value. Thus, "about 60%" means a value of between 60±(20% of 60) (i.e., between 48 and 70).

As used herein, the term "attenuate" means to weaken, reduce or diminish. For example, a polypeptide can be attenuated by modifying the polypeptide to reduce its activity (e.g., by modifying a nucleotide sequence that encodes the polypeptide).

As used herein, the term "biomass" refers to any biological material from which a carbon source is derived. In some instances, a biomass is processed into a carbon source, which is suitable for bioconversion. In other instances, the biomass may not require further processing into a carbon source. The carbon source can be converted into a biofuel. One exemplary source of biomass is plant matter or vegetation. For example, corn, sugar cane, or switchgrass can be used as biomass. Another non-limiting example of biomass is metabolic wastes, such as animal matter, for example cow manure. In addition, biomass may include algae and other marine plants. Biomass also includes waste products from industry, agriculture, forestry, and households. Examples of such waste products that can be used as biomass are fermentation waste, ensilage, straw, lumber, sewage, garbage, cellulosic urban waste, and food leftovers. Biomass also includes sources of carbon, such as carbohydrates (e.g., monosaccharides, disaccharides, or polysaccharides).

As used herein, the phrase "carbon source" refers to a substrate or compound suitable to be used as a source of carbon for prokaryotic or simple eukaryotic cell growth. Carbon sources can be in various forms, including, but not limited to polymers, carbohydrates, acids, alcohols, aldehydes, ketones, amino acids, peptides, and gases (e.g., CO and CO2). These include, for example, various monosaccharides, such as glucose, fructose, mannose, and galactose; oligosaccharides, such as fructo-oligosaccharide and galacto-oligosaccharide; polysaccharides such as xylose and arabinose; disaccharides, such as sucrose, maltose, and turanose; cellulosic material, such as methyl cellulose and sodium carboxymethyl cellulose; saturated or unsaturated fatty acid esters, such as succinate, lactate, and acetate; alcohols, such as ethanol, methanol, and glycerol, or mixtures thereof. The carbon source can also be a product of photosynthesis, including, but not limited to, glucose. A preferred carbon source is biomass. Another preferred carbon source is glucose.

A nucleotide sequence is "complementary" to another nucleotide sequence if each of the bases of the two sequences matches (i.e., is capable of forming Watson Crick base pairs). The term "complementary strand" is used herein interchangeably with the term "complement". The complement of a nucleic acid strand can be the complement of a coding strand or the complement of a non-coding strand.

As used herein, the term "conditions sufficient to allow expression" means any conditions that allow a host cell to produce a desired product, such as a polypeptide or fatty aldehyde described herein. Suitable conditions include, for example, fermentation conditions. Fermentation conditions can comprise many parameters, such as temperature ranges, levels of aeration, and media composition. Each of these conditions, individually and in combination, allows the host cell to grow. Exemplary culture media include broths or gels. Generally, the medium includes a carbon source, such as glucose, fructose, cellulose, or the like, that can be metabolized by a host cell directly. In addition, enzymes can be used in the medium to facilitate the mobilization (e.g., the depolymerization of starch or cellulose to fermentable sugars) and subsequent metabolism of the carbon source.

To determine if conditions are sufficient to allow expression, a host cell can be cultured, for example, for about 4, 8, 12, 24, 36, or 48 hours. During and/or after culturing, samples can be obtained and analyzed to determine if the conditions allow expression. For example, the host cells in the sample or the medium in which the host cells were grown can be tested for the presence of a desired product. When testing for the presence of a product, assays, such as, but not limited to, TLC, HPLC, GC/FID, GC/MS, LC/MS, MS, can be used.

It is understood that the polypeptides described herein may have additional conservative or non-essential amino acid substitutions, which do not have a substantial effect on the polypeptide functions. Whether or not a particular substitution will be tolerated (i.e., will not adversely affect desired biological properties, such as carboxylic acid reductase activity) can be determined as described in Bowie et al. *Science* (1990) 247:1306 1310. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine), and aromatic side chains (e.g., tyrosine, phenylalanine, tryptophan, histidine).

As used herein, "control element" means a transcriptional control element. Control elements include promoters and enhancers. The term "promoter element," "promoter," or "promoter sequence" refers to a DNA sequence that functions as a switch that activates the expression of a gene. If the gene is activated, it is said to be transcribed or participating in transcription. Transcription involves the synthesis of mRNA from the gene. A promoter, therefore, serves as a transcriptional regulatory element and also provides a site for initiation of transcription of the gene into mRNA. Control elements interact specifically with cellular proteins involved in transcription (Maniatis et al., *Science* 236:1237, 1987).

As used herein, the term "fatty acid" means a carboxylic acid having the formula RCOOH. R represents an aliphatic group, preferably an alkyl group. R can comprise between about 4 and about 22 carbon atoms. Fatty acids can be saturated, monounsaturated, or polyunsaturated. In a preferred embodiment, the fatty acid is made from a fatty acid biosynthetic pathway.

As used herein, the term "fatty acid biosynthetic pathway" means a biosynthetic pathway that produces fatty acids. The fatty acid biosynthetic pathway includes fatty acid enzymes that can be engineered, as described herein, to produce fatty acids, and in some embodiments can be expressed with additional enzymes to produce fatty acids having desired carbon chain characteristics.

As used herein, the term "fatty acid degradation enzyme" means an enzyme involved in the breakdown or conversion of a fatty acid or fatty acid derivative into another product. A nonlimiting example of a fatty acid degradation enzyme is an acyl-CoA synthase. Additional examples of fatty acid degradation enzymes are described herein.

As used herein, the term "fatty acid derivative" means products made in part from the fatty acid biosynthetic pathway of the production host organism. "Fatty acid derivative" also includes products made in part from acyl-ACP or acyl-ACP derivatives. The fatty acid biosynthetic pathway includes fatty acid synthase enzymes which can be engineered as described herein to produce fatty acid derivatives, and in some examples can be expressed with additional enzymes to produce fatty acid derivatives having desired carbon chain characteristics. Exemplary fatty acid derivatives include for example, fatty acids, acyl-CoA, fatty aldehyde, short and long chain alcohols, hydrocarbons, fatty alcohols, and esters (e.g., waxes, fatty acid esters, or fatty esters).

As used herein, the term "fatty acid derivative enzyme" means any enzyme that may be expressed or overexpressed in the production of fatty acid derivatives. These enzymes may be part of the fatty acid biosynthetic pathway. Non-limiting examples of fatty acid derivative enzymes include fatty acid synthases, thioesterases, acyl-CoA synthases, acyl-CoA reductases, alcohol dehydrogenases, alcohol acyltransferases, fatty alcohol-forming acyl-CoA reductases, fatty acid (carboxylic acid) reductases, aldehyde reductases, acyl-ACP reductases, fatty acid hydroxylases, acyl-CoA desaturases, acyl-ACP desaturases, acyl-CoA oxidases, acyl-CoA dehydrogenases, ester synthases, and alkane biosynthetic polypeptides, etc. Fatty acid derivative enzymes can convert a substrate into a fatty acid derivative. In some examples, the substrate may be a fatty acid derivative that the fatty acid derivative enzyme converts into a different fatty acid derivative.

As used herein, "fatty acid enzyme" means any enzyme involved in fatty acid biosynthesis. Fatty acid enzymes can be modified in host cells to produce fatty acids. Non-limiting examples of fatty acid enzymes include fatty acid synthases and thioesterases. Additional examples of fatty acid enzymes are described herein.

As used herein, "fatty acid synthase" means any enzyme involved in fatty acid biosynthesis. Fatty acid synthases can be expressed or overexpressed in host cells to produce fatty acids. A non-limiting example of a fatty acid synthase is a thioesterase. Additional examples of fatty acid synthases are described herein.

As used herein, "fatty aldehyde" means an aldehyde having the formula RCHO characterized by an unsaturated carbonyl group (C═O). In a preferred embodiment, the fatty aldehyde is any aldehyde made from a fatty acid or fatty acid derivative. In one embodiment, the R group is at least about 1, 2, 3, 4, 5, 6, 7, 8, 9, 10, 11, 12, 13, 14, 15, 16, 17, 18, 19, or 20 carbons in length.

R can be straight or branched chain. The branched chains may have one or more points of branching. In addition, the branched chains may include cyclic branches.

Furthermore, R can be saturated or unsaturated. If unsaturated, the R can have one or more points of unsaturation.

In one embodiment, the fatty aldehyde is produced biosynthetically.

Fatty aldehydes have many uses. For example, fatty aldehydes can be used to produce many specialty chemicals. For example, fatty aldehydes are used to produce polymers, resins, dyes, flavorings, plasticizers, perfumes, pharmaceuticals, and other chemicals. Some are used as solvents, preservatives, or disinfectants. Some natural and synthetic compounds, such as vitamins and hormones, are aldehydes.

The terms "fatty aldehyde biosynthetic polypeptide", "carboxylic acid reductase", and "CAR" are used interchangeably herein.

As used herein, "fraction of modern carbon" or "$f_M$" has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (plant material), $f_M$ is approximately 1.1.

"Gene knockout", as used herein, refers to a procedure by which a gene encoding a target protein is modified or inactivated so to reduce or eliminate the function of the intact protein. Inactivation of the gene may be performed by general methods such as mutagenesis by UV irradiation or treatment with N-methyl-N'-nitro-N-nitrosoguanidine, site-directed mutagenesis, homologous recombination, insertion-deletion mutagenesis, or "Red-driven integration" (Datsenko et al., *Proc. Natl. Acad. Sci. USA,* 97:6640-45, 2000). For example, in one embodiment, a construct is introduced into a host cell, such that it is possible to select for homologous recombination events in the host cell. One of skill in the art can readily design a knock-out construct including both positive and negative selection genes for efficiently selecting transfected cells that undergo a homologous recombination event with the construct. The alteration in the host cell may be obtained, for example, by replacing through a single or double cross-over recombination a wild type DNA sequence by a DNA sequence containing the alteration. For convenient selection of transformants, the alteration may, for example, be a DNA sequence encoding an antibiotic resistance marker or a gene complementing a possible auxotrophy of the host cell. Mutations include, but are not limited to, deletion-insertion mutations. An example of such an alteration includes a gene disruption, i.e., a perturbation of a gene such that the product that is normally produced from this gene is not produced in a functional form. This could be due to a complete deletion, a deletion and insertion of a selective marker, an insertion of a selective marker, a frameshift mutation, an in-frame deletion, or a point mutation that leads to premature termination. In some instances, the entire mRNA for the gene is absent. In other situations, the amount of mRNA produced varies.

Calculations of "homology" between two sequences can be performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence that is aligned for comparison purposes is at least about 30%, preferably at least about 40%, more preferably at least about 50%, even more preferably at least about 60%, and even more preferably at least about 70%, at least about 80%, at least about 90%, or about 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps and the length of each gap, which need to be introduced for optimal alignment of the two sequences.

The comparison of sequences and determination of percent homology between two sequences can be accomplished using a mathematical algorithm. In a preferred embodiment, the percent homology between two amino acid sequences is determined using the Needleman and Wunsch (1970), J. Mol. Biol. 48:444 453, algorithm that has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent homology between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about which parameters should be applied to determine if a molecule is within a homology limitation of the claims) are a Blossum 62 scoring matrix with a gap penalty of 12, a gap extend penalty of 4, and a frameshift gap penalty of 5.

As used herein, a "host cell" is a cell used to produce a product described herein (e.g., a fatty aldehyde described herein). A host cell can be modified to express or overexpress selected genes or to have attenuated expression of selected genes. Non-limiting examples of host cells include plant, animal, human, bacteria, yeast, or filamentous fungi cells.

As used herein, the term "hybridizes under low stringency, medium stringency, high stringency, or very high stringency conditions" describes conditions for hybridization and washing. Guidance for performing hybridization reactions can be found in Current Protocols in Molecular Biology, John Wiley & Sons, N.Y. (1989), 6.3.1-6.3.6. Aqueous and non-aqueous methods are described in that reference and either method can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions unless otherwise specified.

The term "isolated" as used herein with respect to nucleic acids, such as DNA or RNA, refers to molecules separated from other DNAs or RNAs, respectively, that are present in the natural source of the nucleic acid. Moreover, by an "isolated nucleic acid" is meant to include nucleic acid fragments, which are not naturally occurring as fragments and would not be found in the natural state. The term "isolated" is also used herein to refer to polypeptides, which are isolated from other cellular proteins and is meant to encompass both purified and recombinant polypeptides. The term "isolated" as used herein also refers to a nucleic acid or peptide that is substantially free of cellular material, viral material, or culture medium when produced by recombinant DNA techniques. The term "isolated" as used herein also refers to a nucleic acid or peptide that is substantially free of chemical precursors or other chemicals when chemically synthesized. The term "isolated", as used herein with respect to products, such as fatty aldehydes, refers to products that are isolated from cellular components, cell culture media, or chemical or synthetic precursors.

As used herein, the "level of expression of a gene in a cell" refers to the level of mRNA, pre-mRNA nascent transcript(s), transcript processing intermediates, mature mRNA(s), and degradation products encoded by the gene in the cell.

As used herein, the term "microorganism" means prokaryotic and eukaryotic microbial species from the domains Archaea, Bacteria and Eucarya, the latter including yeast and filamentous fungi, protozoa, algae, or higher Protista. The terms "microbial cells" (i.e., cells from microbes) and "microbes" are used interchangeably and refer to cells or small organisms that can only be seen with the aid of a microscope.

As used herein, the term "nucleic acid" refers to polynucleotides, such as deoxyribonucleic acid (DNA), and, where appropriate, ribonucleic acid (RNA). The term should also be understood to include, as equivalents, analogs of either RNA or DNA made from nucleotide analogs, and, as applicable to the embodiment being described, single (sense or antisense) and double-stranded polynucleotides, ESTs, chromosomes, cDNAs, mRNAs, and rRNAs.

As used herein, the term "operably linked" means that selected nucleotide sequence (e.g., encoding a polypeptide described herein) is in proximity with a promoter to allow the promoter to regulate expression of the selected DNA. In addition, the promoter is located upstream of the selected nucleotide sequence in terms of the direction of transcription and translation. By "operably linked" is meant that a nucleotide sequence and a regulatory sequence(s) are connected in such a way as to permit gene expression when the appropriate molecules (e.g., transcriptional activator proteins) are bound to the regulatory sequence(s).

The term "or" is used herein to mean, and is used interchangeably with, the term "and/or," unless context clearly indicates otherwise.

As used herein, "overexpress" means to express or cause to be expressed a nucleic acid, polypeptide, or hydrocarbon in a cell at a greater concentration than is normally expressed in a corresponding wild-type cell. For example, a polypeptide can be "overexpressed" in a recombinant host cell when the polypeptide is present in a greater concentration in the recombinant host cell compared to its concentration in a non-recombinant host cell of the same species.

As used herein, "partition coefficient" or "P," is defined as the equilibrium concentration of a compound in an organic phase divided by the concentration at equilibrium in an aqueous phase (e.g., fermentation broth). In one embodiment of a bi-phasic system described herein, the organic phase is formed by the fatty aldehyde during the production process. However, in some examples, an organic phase can be provided, such as by providing a layer of octane, to facilitate product separation. When describing a two phase system, the partition characteristics of a compound can be described as log P. For example, a compound with a log P of 1 would partition 10:1 to the organic phase. A compound with a log P of −1 would partition 1:10 to the organic phase. By choosing an appropriate fermentation broth and organic phase, a fatty aldehyde with a high logP value can separate into the organic phase even at very low concentrations in the fermentation vessel.

As used herein, the term "purify," "purified," or "purification" means the removal or isolation of a molecule from its environment by, for example, isolation or separation. "Substantially purified" molecules are at least about 60% free, preferably at least about 75% free, and more preferably at least about 90% free from other components with which they are associated. As used herein, these terms also refer to the removal of contaminants from a sample. For example, the removal of contaminants can result in an increase in the percentage of fatty aldehyde in a sample. For example, when fatty aldehydes are produced in a host cell, the fatty aldehydes can be purified by the removal of host cell proteins. After purification, the percentage of fatty aldehydes in the sample is increased.

The terms "purify," "purified," and "purification" do not require absolute purity. They are relative terms. Thus, for example, when fatty aldehydes are produced in host cells, a purified fatty aldehyde is one that is substantially separated from other cellular components (e.g., nucleic acids, polypeptides, lipids, carbohydrates, or other hydrocarbons). In another example, a purified fatty aldehyde preparation is one in which the fatty aldehyde is substantially free from contaminants, such as those that might be present following fermentation. In some embodiments, a fatty aldehyde is purified when at least about 50% by weight of a sample is composed of the fatty aldehyde. In other embodiments, a fatty aldehyde is purified when at least about 60%, 70%, 80%, 85%, 90%, 92%, 95%, 98%, or 99% or more by weight of a sample is composed of the fatty aldehyde.

As used herein, the term "recombinant polypeptide" refers to a polypeptide that is produced by recombinant DNA techniques, wherein generally DNA encoding the expressed protein or RNA is inserted into a suitable expression vector and that is in turn used to transform a host cell to produce the polypeptide or RNA.

As used herein, the term "substantially identical" (or "substantially homologous") is used to refer to a first amino acid or nucleotide sequence that contains a sufficient number of identical or equivalent (e.g., with a similar side chain, e.g., conserved amino acid substitutions) amino acid residues or nucleotides to a second amino acid or nucleotide sequence such that the first and second amino acid or nucleotide sequences have similar activities.

As used herein, the term "synthase" means an enzyme which catalyzes a synthesis process. As used herein, the term synthase includes synthases, synthetases, and ligases.

As used herein, the term "transfection" means the introduction of a nucleic acid (e.g., via an expression vector) into a recipient cell by nucleic acid-mediated gene transfer.

As used herein, "transformation" refers to a process in which a cell's genotype is changed as a result of the cellular uptake of exogenous DNA or RNA. This may result in the transformed cell expressing a recombinant form of an RNA or polypeptide. In the case of antisense expression from the transferred gene, the expression of a naturally-occurring form of the polypeptide is disrupted.

As used herein, a "transport protein" is a polypeptide that facilitates the movement of one or more compounds in and/or out of a cellular organelle and/or a cell.

As used herein, a "variant" of polypeptide X refers to a polypeptide having the amino acid sequence of peptide X in which one or more amino acid residues is altered. The variant may have conservative changes or nonconservative changes. Guidance in determining which amino acid residues may be substituted, inserted, or deleted without affecting biological activity may be found using computer programs well known in the art, for example, LASERGENE software (DNASTAR).

The term "variant," when used in the context of a polynucleotide sequence, may encompass a polynucleotide sequence related to that of a gene or the coding sequence thereof. This definition may also include, for example, "allelic," "splice," "species," or "polymorphic" variants. A splice variant may have significant identity to a reference polynucleotide, but will generally have a greater or lesser number of polynucleotides due to alternative splicing of exons during mRNA processing. The corresponding polypeptide may possess additional functional domains or an absence of domains. Species variants are polynucleotide sequences that vary from one species to another. The resulting polypeptides generally will have significant amino acid identity relative to each other. A polymorphic variant is a variation in the polynucleotide sequence of a particular gene between individuals of a given species.

As used herein, the term "vector" refers to a nucleic acid molecule capable of transporting another nucleic acid to which it has been linked. One type of useful vector is an episome (i.e., a nucleic acid capable of extra-chromosomal replication). Useful vectors are those capable of autonomous replication and/or expression of nucleic acids to which they are linked. Vectors capable of directing the expression of genes to which they are operatively linked are referred to herein as "expression vectors". In general, expression vectors of utility in recombinant DNA techniques are often in the form of "plasmids," which refer generally to circular double stranded DNA loops that, in their vector form, are not bound to the chromosome. In the present specification, "plasmid" and "vector" are used interchangeably, as the plasmid is the most commonly used form of vector. However, also included are such other forms of expression vectors that serve equivalent functions and that become known in the art subsequently hereto.

The invention is based, at least in part, on the discovery of a new pathway for fatty aldehyde biosynthesis in *E. coli* and the identification of genes that encode fatty aldehyde biosynthetic polypeptides. The fatty aldehyde biosynthetic polypeptides participate in a biosynthetic pathway depicted in FIG. 1. In this pathway, a fatty acid is first activated by ATP and then reduced by a carboxylic acid reductase (CAR)-like enzyme to generate a fatty aldehyde. Accordingly, the fatty aldehyde biosynthetic nucleotides and polypeptides described herein can be utilized to produce fatty aldehydes.

Fatty Aldehyde Biosynthetic Genes and Variants

The methods and compositions described herein include, for example, fatty aldehyde biosynthetic genes, for example carboxylic acid reductase genes (car genes), having a nucleotide sequence listed in FIGS. 2 and 4, as well as polynucleotide variants thereof. In some instances, the fatty aldehyde biosynthetic gene encodes one or more of the amino acid motifs depicted in FIG. 3. For example, the gene can encode a polypeptide comprising SEQ ID NO:7, SEQ ID NO:8, SEQ ID NO:9, and SEQ ID NO:10; SEQ ID NO:11; SEQ ID NO:12; SEQ ID NO:13; SEQ ID NO:14; and/or SEQ ID NO:7, SEQ ID NO:9, SEQ ID NO:10, and SEQ ID NO:11. SEQ ID NO:7 includes a reductase domain; SEQ ID NO:8 and SEQ ID NO:14 include a NADP binding domain; SEQ ID NO:9 includes a phosphopantetheine attachment site; and SEQ ID NO:10 includes an AMP binding domain.

Variants can be naturally occurring or created in vitro. In particular, such variants can be created using genetic engineering techniques, such as site directed mutagenesis, random chemical mutagenesis, Exonuclease III deletion procedures, or standard cloning techniques. Alternatively, such variants, fragments, analogs, or derivatives can be created using chemical synthesis or modification procedures.

Methods of making variants are well known in the art. These include procedures in which nucleic acid sequences obtained from natural isolates are modified to generate nucleic acids that encode polypeptides having characteristics that enhance their value in industrial or laboratory applications. In such procedures, a large number of variant sequences having one or more nucleotide differences with respect to the sequence obtained from the natural isolate are generated and characterized. Typically, these nucleotide differences result in amino acid changes with respect to the polypeptides encoded by the nucleic acids from the natural isolates.

For example, variants can be created using error prone PCR (see, e.g., Leung et al., *Technique* 1:11-15, 1989; and Caldwell et al., *PCR Methods Applic.* 2:28-33, 1992). In error prone PCR, PCR is performed under conditions where the copying fidelity of the DNA polymerase is low, such that a high rate of point mutations is obtained along the entire length of the PCR product. Briefly, in such procedures, nucleic acids to be mutagenized (e.g., a fatty aldehyde biosynthetic polynucleotide sequence), are mixed with PCR primers, reaction buffer, $MgCl_2$, $MnCl_2$, Taq polymerase, and an appropriate concentration of dNTPs for achieving a high rate of point mutation along the entire length of the PCR product. For example, the reaction can be performed using 20 fmoles of nucleic acid to be mutagenized (e.g., a fatty aldehyde biosynthetic polynucleotide sequence), 30 pmole of each PCR primer, a reaction buffer comprising 50 mM KCl, 10 mM Tris HCl (pH 8.3), and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR can be performed for 30 cycles of 94° C. for 1 min, 45° C. for 1 min, and 72° C. for 1 min. However, it will be appreciated that these parameters can be varied as appropriate. The mutagenized nucleic acids are then cloned into an appropriate vector and the activities of the polypeptides encoded by the mutagenized nucleic acids are evaluated.

Variants can also be created using oligonucleotide directed mutagenesis to generate site-specific mutations in any cloned DNA of interest. Oligonucleotide mutagenesis is described in, for example, Reidhaar-Olson et al., *Science* 241:53-57, 1988. Briefly, in such procedures a plurality of double stranded oligonucleotides bearing one or more mutations to be introduced into the cloned DNA are synthesized and inserted into the cloned DNA to be mutagenized (e.g., a fatty aldehyde biosynthetic polynucleotide sequence). Clones containing the mutagenized DNA are recovered, and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, for example, U.S. Pat. No. 5,965,408.

Still another method of generating variants is sexual PCR mutagenesis. In sexual PCR mutagenesis, forced homologous recombination occurs between DNA molecules of different, but highly related, DNA sequence in vitro as a result of random fragmentation of the DNA molecule based on sequence homology. This is followed by fixation of the crossover by primer extension in a PCR reaction. Sexual PCR mutagenesis is described in, for example, Stemmer, *PNAS, USA* 91:10747-10751, 1994.

Variants can also be created by in vivo mutagenesis. In some embodiments, random mutations in a nucleic acid sequence are generated by propagating the sequence in a bacterial strain, such as an *E. coli* strain, which carries mutations in one or more of the DNA repair pathways. Such "mutator" strains have a higher random mutation rate than that of a wild-type strain. Propagating a DNA sequence (e.g., a fatty aldehyde biosynthetic polynucleotide sequence) in one of these strains will eventually generate random mutations within the DNA. Mutator strains suitable for use for in vivo mutagenesis are described in, for example, PCT Publication No. WO 91/16427.

Variants can also be generated using cassette mutagenesis. In cassette mutagenesis, a small region of a double stranded DNA molecule is replaced with a synthetic oligonucleotide "cassette" that differs from the native sequence. The oligonucleotide often contains a completely and/or partially randomized native sequence.

Recursive ensemble mutagenesis can also be used to generate variants. Recursive ensemble mutagenesis is an algorithm for protein engineering (i.e., protein mutagenesis) developed to produce diverse populations of phenotypically related mutants whose members differ in amino acid sequence. This method uses a feedback mechanism to control successive rounds of combinatorial cassette mutagenesis. Recursive ensemble mutagenesis is described in, for example, Arkin et al., *PNAS, USA* 89:7811-7815, 1992.

In some embodiments, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described in, for example, Delegrave et al., *Biotech. Res.* 11:1548-1552, 1993. Random and site-directed mutagenesis are described in, for example, Arnold, *Curr. Opin. Biotech.* 4:450-455, 1993.

In some embodiments, variants are created using shuffling procedures wherein portions of a plurality of nucleic acids that encode distinct polypeptides are fused together to create chimeric nucleic acid sequences that encode chimeric polypeptides as described in, for example, U.S. Pat. Nos. 5,965,408 and 5,939,250.

Polynucleotide variants also include nucleic acid analogs. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine and 5-methyl-2'-deoxycytidine or 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered, morpholino ring, or peptide nucleic acids, in which the deoxyphosphate backbone is replaced by a pseudopeptide backbone and the four bases are retained. (See, e.g., Summerton et al., *Antisense Nucleic Acid Drug Dev.* (1997) 7:187-195; and Hyrup et al., *Bioorgan. Med. Chem.* (1996) 4:5-23.) In addition, the deoxyphosphate backbone can be replaced with, for example, a phosphorothioate or phosphorodithioate backbone, a phosphoroamidite, or an alkyl phosphotriester backbone.

Any polynucleotide sequence encoding a homolog listed in FIGS. 2 and 4, or a variant thereof, can be used as a fatty aldehyde biosynthetic polynucleotide in the methods described herein.

Fatty Aldehyde Biosynthetic Polypeptides and Variants

The methods and compositions described herein also include fatty aldehyde biosynthetic polypeptides having an amino acid sequence listed in FIGS. 2 and 4, as well as polypeptide variants thereof. In some instances, a fatty aldehyde biosynthetic polypeptide is one that includes one or more of the amino acid motifs depicted in FIG. 3. For example, the polypeptide can include the amino acid sequences of SEQ ID NO:7, SEQ ID NO:8, SEQ ID NO:9, and SEQ ID NO:10. In other situations, the polypeptide includes one or more of SEQ ID NO:11, SEQ ID NO:12, SEQ ID NO:13, and SEQ ID NO:14. In yet other instances, the polypeptide includes the amino acid sequences of SEQ ID NO:7, SEQ ID NO:9, SEQ ID NO:10, and SEQ ID NO:11. SEQ ID NO:7 includes a reductase domain; SEQ ID NO:8 and SEQ ID NO:14 include a NADP binding domain; SEQ ID NO:9 includes a phosphopantetheine attachment site; and SEQ ID NO:10 includes an AMP binding domain.

Fatty aldehyde biosynthetic polypeptide variants can be variants in which one or more amino acid residues are substituted with a conserved or non-conserved amino acid residue (preferably a conserved amino acid residue). Such substituted amino acid residue may or may not be one encoded by the genetic code.

Conservative substitutions are those that substitute a given amino acid in a polypeptide by another amino acid of similar characteristics. Typical conservative substitutions are the following replacements: replacement of an aliphatic amino acid, such as alanine, valine, leucine, and isoleucine, with another aliphatic amino acid; replacement of a serine with a threonine or vice versa; replacement of an acidic residue, such as aspartic acid and glutamic acid, with another acidic residue; replacement of a residue bearing an amide group, such as asparagine and glutamine, with another residue bearing an amide group; exchange of a basic residue, such as lysine and arginine, with another basic residue; and replacement of an aromatic residue, such as phenylalanine and tyrosine, with another aromatic residue.

Other polypeptide variants are those in which one or more amino acid residues include a substituent group. Still other polypeptide variants are those in which the polypeptide is associated with another compound, such as a compound to increase the half-life of the polypeptide (e.g., polyethylene glycol).

Additional polypeptide variants are those in which additional amino acids are fused to the polypeptide, such as a leader sequence, a secretory sequence, a proprotein sequence, or a sequence which facilitates purification, enrichment, or stabilization of the polypeptide.

In some instances, the polypeptide variants retain the same biological function as a polypeptide having an amino acid sequence listed in FIGS. 2 and 4 (e.g., retain fatty aldehyde biosynthetic activity, such as carboxylic acid or fatty acid reductase activity) and have amino acid sequences substantially identical thereto.

In other instances, the polypeptide variants have at least about 50%, at least about 55%, at least about 60%, at least about 65%, at least about 70%, at least about 75%, at least about 80%, at least about 85%, at least about 90%, at least about 95%, or more than about 95% homology to an amino acid sequence listed in FIGS. 2 and 4. In another embodiment, the polypeptide variants include a fragment comprising at least about 5, 10, 15, 20, 25, 30, 35, 40, 50, 75, 100, or 150 consecutive amino acids thereof.

The polypeptide variants or fragments thereof can be obtained by isolating nucleic acids encoding them using techniques described herein or by expressing synthetic nucleic acids encoding them. Alternatively, polypeptide variants or fragments thereof can be obtained through biochemical enrichment or purification procedures. The sequence of polypeptide variants or fragments can be determined by proteolytic digestion, gel electrophoresis, and/or microsequencing. The sequence of the polypeptide variants or fragments can then be compared to an amino acid sequence listed in FIGS. 2 and 4 using any of the programs described herein.

The polypeptide variants and fragments thereof can be assayed for fatty aldehyde-producing activity using routine methods. For example, the polypeptide variants or fragment can be contacted with a substrate (e.g., a fatty acid, a fatty acid derivative substrate, or other substrate described herein) under conditions that allow the polypeptide variant to function. A decrease in the level of the substrate or an increase in the level of a fatty aldehyde can be measured to determine fatty aldehyde-producing activity.

Anti-Fatty Aldehyde Biosynthetic Polypeptide Antibodies

The fatty aldehyde biosynthetic polypeptides described herein can also be used to produce antibodies directed against fatty aldehyde biosynthetic polypeptides. Such antibodies can be used, for example, to detect the expression of a fatty aldehyde biosynthetic polypeptide using methods known in the art. The antibody can be, for example, a polyclonal antibody; a monoclonal antibody or antigen binding fragment thereof; a modified antibody such as a chimeric antibody, reshaped antibody, humanized antibody, or fragment thereof (e.g., Fab', Fab, $F(ab')_2$); or a biosynthetic antibody, for example, a single chain antibody, single domain antibody (DAB), Fv, single chain Fv (scFv), or the like.

Methods of making and using polyclonal and monoclonal antibodies are described, for example, in Harlow et al., *Using Antibodies: A Laboratory Manual: Portable Protocol I*. Cold Spring Harbor Laboratory (Dec. 1, 1998). Methods for making modified antibodies and antibody fragments (e.g., chimeric antibodies, reshaped antibodies, humanized antibodies, or fragments thereof, e.g., Fab', Fab, $F(ab')_2$ fragments); or biosynthetic antibodies (e.g., single chain antibodies, single domain antibodies (DABs), Fv, single chain Fv (scFv), and the like), are known in the art and can be found, for example, in Zola, *Monoclonal Antibodies: Preparation and Use of Monoclonal Antibodies and Engineered Antibody Derivatives*, Springer Verlag (Dec. 15, 2000; 1st edition).

Substrates

The compositions and methods described herein can be used to produce fatty aldehydes from an appropriate substrate. While not wishing to be bound by theory, it is believed that the polypeptides described herein produce fatty aldehydes from substrates via a reduction mechanism. In some instances, the substrate is a fatty acid derivative (e.g., a fatty acid), and a fatty aldehyde having particular branching patterns and carbon chain length can be produced from a fatty acid derivative having those characteristics that would result in the desired fatty aldehyde.

Accordingly, each step within a biosynthetic pathway that leads to the production of a fatty acid derivative substrates can be modified to produce or overproduce the substrate of interest. For example, known genes involved in the fatty acid biosynthetic pathway or the fatty aldehyde pathway can be expressed, overexpressed, or attenuated in host cells to produce a desired substrate (see, e.g., PCT/US08/058788). Exemplary genes are provided in FIG. 5.

Synthesis of Substrates

Fatty acid synthase (FAS) is a group of polypeptides that catalyze the initiation and elongation of acyl chains (Marrakchi et al., *Biochemical Society,* 30:1050-1055, 2002). The acyl carrier protein (ACP) along with the enzymes in the FAS pathway control the length, degree of saturation, and branching of the fatty acid derivatives produced. The fatty acid biosynthetic pathway involves the precursors acetyl-CoA and malonyl-CoA. The steps in this pathway are catalyzed by enzymes of the fatty acid biosynthesis (fab) and acetyl-CoA carboxylase (acc) gene families (see, e.g., Heath et al., *Prog. Lipid Res.* 40(6):467-97 (2001)).

Host cells can be engineered to express fatty acid derivative substrates by recombinantly expressing or overexpressing one or more fatty acid synthase genes, such as acetyl-CoA and/or malonyl-CoA synthase genes. For example, to increase acetyl-CoA production, one or more of the following genes can be expressed in a host cell: pdh (a multienzyme complex comprising aceEF (which encodes the E1p dehydrogenase component, the E2p dihydrolipoamide acyltransferase component of the pyruvate and 2-oxoglutarate dehydrogenase complexes, and lpd), panK, fabH, fabB, fabD, fabG, acpP, and fabF. Exemplary GenBank accession numbers for these genes are: pdh (BAB34380, AAC73227, AAC73226), panK (also known as CoA, AAC76952), aceEF (AAC73227, AAC73226), fabH (AAC74175), fabB (P0A953), fabD (AAC74176), fabG (AAC74177), acpP (AAC74178), fabF (AAC74179). Additionally, the expression levels offadE, gpsA, ldhA, pflb, adhE, pta, poxB, ackA, and/or ackB can be attenuated or knocked-out in an engineered host cell by transformation with conditionally replicative or non-replicative plasmids containing null or deletion mutations of the corresponding genes or by substituting promoter or enhancer sequences. Exemplary GenBank accession numbers for these genes are: fadE (AAC73325), gspA (AAC76632), ldhA (AAC74462), pflb (AAC73989), adhE (AAC74323), pta (AAC75357), poxB (AAC73958), ackA (AAC75356), and ackB (BAB81430). The resulting host cells will have increased acetyl-CoA production levels when grown in an appropriate environment.

Malonyl-CoA overexpression can be affected by introducing accABCD (e.g., accession number AAC73296, EC 6.4.1.2) into a host cell. Fatty acids can be further overexpressed in host cells by introducing into the host cell a DNA sequence encoding a lipase (e.g., accession numbers CAA89087, CAA98876).

In addition, inhibiting PlsB can lead to an increase in the levels of long chain acyl-ACP, which will inhibit early steps in the pathway (e.g., accABCD, fabH, and fabl). The plsB (e.g., accession number AAC77011) D311E mutation can be used to increase the amount of available fatty acids.

In addition, a host cell can be engineered to overexpress a sfa gene (suppressor of fabA, e.g., accession number AAN79592) to increase production of monounsaturated fatty acids (Rock et al., *J. Bacteriology* 178:5382-5387, 1996).

The chain length of a fatty acid derivative substrate can be selected for by modifying the expression of selected thioesterases. Thioesterase influences the chain length of fatty acids produced. Hence, host cells can be engineered to express, overexpress, have attenuated expression, or not to express one or more selected thioesterases to increase the production of a preferred fatty acid derivative substrate. For example, $C_{10}$ fatty acids can be produced by expressing a thioesterase that has a preference for producing $C_{10}$ fatty acids and attenuating thioesterases that have a preference for producing fatty acids other than $C_{10}$ fatty acids (e.g., a thioesterase which prefers to produce $C_{14}$ fatty acids). This would result in a relatively homogeneous population of fatty acids that have a carbon chain length of 10. In other instances, $C_{14}$ fatty acids can be produced by attenuating endogenous thioesterases that produce non-$C_{14}$ fatty acids and expressing the thioesterases that use $C_{14}$-ACP. In some situations, $C_{12}$ fatty acids can be produced by expressing thioesterases that use $C_{12}$-ACP and attenuating thioesterases that produce non-$C_{12}$ fatty acids. Acetyl-CoA, malonyl-CoA, and fatty acid overproduction can be verified using methods known in the art, for example, by using radioactive precursors, HPLC, or GC-MS subsequent to cell lysis. Non-limiting examples of thioesterases that can be used in the methods described herein are listed in Table 1.

TABLE 1

| Thioesterases | | |
|---|---|---|
| Accession Number | Source Organism | Gene |
| AAC73596 | *E. coli* | tesA without leader sequence |
| AAC73555 | *E. coli* | tesB |
| Q41635, AAA34215 | *Umbellularia california* | fatB |
| AAC49269 | *Cuphea hookeriana* | fatB2 |
| Q39513; AAC72881 | *Cuphea hookeriana* | fatB3 |
| Q39473, AAC49151 | *Cinnamonum camphorum* | fatB |
| CAA85388 | *Arabidopsis thaliana* | fatB [M141T]* |
| NP 189147; NP 193041 | *Arabidopsis thaliana* | fatA |
| CAC39106 | *Bradyrhiizobium japonicum* | fatA |
| AAC72883 | *Cuphea hookeriana* | fatA |
| AAL79361 | *Helianthus annus* | fatA1 |

*Mayer et al., BMC Plant Biology 7: 1-11, 2007

In other instances, a fatty aldehyde biosynthetic polypeptide, variant, or a fragment thereof, is expressed in a host cell that contains a naturally occurring mutation that results in an increased level of fatty acids in the host cell. In some instances, the host cell is genetically engineered to increase the level of fatty acids in the host cell relative to a corresponding wild-type host cell. For example, the host cell can be genetically engineered to express a reduced level of an acyl-CoA synthase relative to a corresponding wild-type host cell. In one embodiment, the level of expression of one or more genes (e.g., an acyl-CoA synthase gene) is reduced by genetically engineering a "knock out" host cell.

Any known acyl-CoA synthase gene can be reduced or knocked out in a host cell. Non-limiting examples of acyl-CoA synthase genes include fadD, fadK, BH3103, yhfL, Pfl-4354, EAV15023, fadD1, fadD2, RPC_4074, fadDD35, fadDD22, faa3p or the gene encoding the protein ZP_01644857. Specific examples of acyl-CoA synthase genes include fadDD35 from *M. tuberculosis* H37Rv [NP_217021], fadDD22 from *M. tuberculosis* H37Rv [NP_217464], fadD from *E. coli* [NP_416319], fadK from *E. coli* [YP_416216], fadD from *Acinetobacter* sp. ADP1 [YP_045024], fadD from *Haemophilus influenza* RdkW20 [NP_438551], fadD from *Rhodopseudomonas palustris* Bis B18 [YP_533919], BH3101 from *Bacillus halodurans* C-125 [NP_243969], Pfl-4354 from *Pseudomonas fluorescens* Pfo-1 [YP_350082], EAV15023 from *Comamonas testosterone* KF-1 [ZP_01520072], yhfL from *B. subtilis* [NP_388908], fadD1 from *P. aeruginosa* PAO1 [NP_251989], fadD1 from *Ralstonia solanacearum* GM1 1000 [NP_520978], fadD2 from *P. aeruginosa* PAO1 [NP_251990], the gene encoding the protein ZP_01644857 from *Stenotrophomonas maltophilia* R551-3, faa3p from *Saccharomyces cerevisiae* [NP_012257], faa1p, from *Saccharomyces cerevisiae* [NP_014962], lcfA from *Bacillus subtilis* [CAA99571], or those described in Shockey et al., *Plant. Physiol.* 129: 1710-1722, 2002; Caviglia et al., *J. Biol. Chem.* 279:1163-1169, 2004; Knoll et al., *J. Biol. Chem.* 269(23):16348-56, 1994; Johnson et al., *J. Biol. Chem.* 269: 18037-18046, 1994; and Black et al., *J. Biol. Chem.* 267: 25513-25520, 1992.

Formation of Branched Fatty Aldehydes

Fatty aldehydes can be produced that contain branch points by using branched fatty acid derivatives as substrates. For example, although *E. coli* naturally produces straight chain fatty acids (sFAs), *E. coli* can be engineered to produce branched chain fatty acids (brFAs) by introducing and expressing or overexpressing genes that provide branched precursors in the *E. coli* (e.g., bkd, ilv, icm, and fab gene families). Additionally, a host cell can be engineered to express or overexpress genes encoding proteins for the elongation of brFAs (e.g., ACP, FabF, etc.) and/or to delete or attenuate the corresponding host cell genes that normally lead to sFAs.

The first step in forming brFAs is the production of the corresponding α-keto acids by a branched-chain amino acid aminotransferase. Host cells may endogenously include genes encoding such enzymes or such genes can be recombinantly introduced. *E. coli*, for example, endogenously expresses such an enzyme, IlvE (EC 2.6.1.42; GenBank accession YP_026247). In some host cells, a heterologous branched-chain amino acid aminotransferase may not be expressed. However, *E. coli* IlvE or any other branched-chain amino acid aminotransferase (e.g., IlvE from *Lactococcus lactis* (GenBank accession AAF34406), IlvE from *Pseudomonas putida* (GenBank accession NP_745648), or IlvE from *Streptomyces coelicolor* (GenBank accession NP_629657)), if not endogenous, can be introduced.

In another embodiment, the production of a-keto acids can be achieved by using the methods described in Atsumi et al., *Nature* 451:86-89, 2008. For example, 2-ketoisovalerate can be produced by overexpressing the genes encoding IlvI, IlvH, IlvC, or IlvD. In another example, 2-keto-3-methyl-valerate can be produced by overexpressing the genes encoding IlvA and IlvI, IlvH (or AlsS of *Bacillus subtilis*), IlvC, IlvD, or their corresponding homologs. In a further embodiment, 2-keto-4-methyl-pentanoate can be produced by overexpressing the genes encoding IlvI, IlvH, IlvC, IlvD and LeuA, LeuB, LeuC, LeuD, or their corresponding homologs.

The second step is the oxidative decarboxylation of the α-keto acids to the corresponding branched-chain acyl-CoA. This reaction can be catalyzed by a branched-chain α-keto acid dehydrogenase complex (bkd; EC 1.2.4.4.) (Denoya et al., *J. Bacteriol.* 177:3504, 1995), which consists of E1α/β (decarboxylase), E2 (dihydrolipoyl transacylase), and E3 (dihydrolipoyl dehydrogenase) subunits. These branched-chain α-keto acid dehydrogenase complexes are similar to pyruvate and α-ketoglutarate dehydrogenase complexes. Any microorganism that possesses brFAs and/or grows on branched-chain amino acids can be used as a source to isolate bkd genes for expression in host cells, for example, *E. coli*. Furthermore, *E. coli* has the E3 component as part of its pyruvate dehydrogenase complex (lpd, EC 1.8.1.4, GenBank accession NP_414658). Thus, it may be sufficient to express only the E1α/β and E2 bkd genes. Table 2 lists non-limiting examples of bkd genes from several microorganisms that can be recombinantly introduced and expressed in a host cell to provide branched-chain acyl-CoA precursors.

TABLE 2

Bkd genes from selected microorganisms

| Organism | Gene | GenBank Accession # |
|---|---|---|
| *Streptomyces coelicolor* | bkdA1 (E1α) | NP_628006 |
| | bkdB1 (E1β) | NP_628005 |
| | bkdC1 (E2) | NP_638004 |
| *Streptomyces coelicolor* | bkdA2 (E1α) | NP_733618 |
| | bkdB2 (E1β) | NP_628019 |
| | bkdC2 (E2) | NP_628018 |
| *Streptomyces avermitilis* | bkdA (E1a) | BAC72074 |
| | bkdB (E1b) | BAC72075 |
| | bkdC (E2) | BAC72076 |
| *Streptomyces avermitilis* | bkdF (E1α) | BAC72088 |
| | bkdG (E1β) | BAC72089 |
| | bkdH (E2) | BAC72090 |
| *Bacillus subtilis* | bkdAA (E1α) | NP_390288 |
| | bkdAB (E1β) | NP_390288 |
| | bkdB (E2) | NP_390288 |
| *Pseudomonas putida* | bkdA1 (E1α) | AAA65614 |
| | bkdA2 (E1β) | AAA65615 |
| | bkdC (E2) | AAA65617 |

In another example, isobutyryl-CoA can be made in a host cell, for example in *E. coli*, through the coexpression of a crotonyl-CoA reductase (Ccr, EC 1.6.5.5, 1.1.1.1) and isobutyryl-CoA mutase (large subunit IcmA, EC 5.4.99.2; small subunit IcmB, EC 5.4.99.2) (Han and Reynolds, *J. Bacteriol.* 179:5157, 1997). Crotonyl-CoA is an intermediate in fatty acid biosynthesis in *E. coli* and other microorganisms. Non-limiting examples of ccr and icm genes from selected microorganisms are listed in Table 3.

TABLE 3

Ccr and icm genes from selected microorganisms

| Organism | Gene | GenBank Accession # |
|---|---|---|
| *Streptomyces coelicolor* | ccr | NP_630556 |
| | icmA | NP_629554 |
| | icmB | NP_630904 |
| *Streptomyces cinnamonensis* | ccr | AAD53915 |
| | icmA | AAC08713 |
| | icmB | AJ246005 |

In addition to expression of the bkd genes, the initiation of brFA biosynthesis utilizes β-ketoacyl-acyl-carrier-protein synthase III (FabH, EC 2.3.1.41) with specificity for branched chain acyl-CoAs (Li et al., *J. Bacteriol.* 187:3795-3799, 2005). Non-limiting examples of such FabH enzymes are listed in Table 4. fabH genes that are involved in fatty acid biosynthesis of any brFA-containing microorganism can be expressed in a host cell. The Bkd and FabH enzymes from host cells that do not naturally make brFA may not support brFA production. Therefore, bkd and fabH can be expressed recombinantly. Vectors containing the bkd and fabH genes can be inserted into such a host cell. Similarly, the endogenous level of Bkd and FabH production may not be sufficient to produce brFA. In this case, they can be overexpressed. Additionally, other components of the fatty acid biosynthesis pathway can be expressed or overexpressed, such as acyl carrier proteins (ACPs) and β-ketoacyl-acyl-carrier-protein synthase II (fabF, EC 2.3.1.41) (non-limiting examples of candidates are listed in Table 4). In addition to expressing these genes, some genes in the endogenous fatty acid biosynthesis pathway can be attenuated in the host cell (e.g., the *E. coli* genes fabH (GenBank accession # NP_415609) and/or fabF (GenBank accession # NP_415613)).

TABLE 4

FabH, ACP and fabF genes from selected microorganisms with brFAs

| Organism | Gene | GenBank Accession # |
|---|---|---|
| *Streptomyces coelicolor* | fabH1 | NP_626634 |
| | acp | NP_626635 |
| | fabF | NP_626636 |
| *Streptomyces avermitilis* | fabH3 | NP_823466 |
| | fabC3 (acp) | NP_823467 |
| | fabF | NP_823468 |
| *Bacillus subtilis* | fabH_A | NP_389015 |
| | fabH_B | NP_388898 |
| | acp | NP_389474 |
| | fabF | NP_389016 |
| *Stenotrophomonas maltophilia* | SmalDRAFT_0818 (fabH) | ZP_01643059 |
| | SmalDRAFT_0821 (acp) | ZP_01643063 |
| | SmalDRAFT_0822 (fabF) | ZP_01643064 |
| *Legionella pneumophila* | fabH | YP_123672 |
| | acp | YP_123675 |
| | fabF | YP_123676 |

Formation of Cyclic Fatty Aldehydes

Cyclic fatty aldehydes can be produced by using cyclic fatty acid derivatives as substrates. To produce cyclic fatty acid derivative substrates, genes that provide cyclic precursors (e.g., the ans, chc, and plm gene families) can be introduced into the host cell and expressed to allow initiation of fatty acid biosynthesis from cyclic precursors. For example, to convert a host cell, such as *E. coli*, into one capable of synthesizing w-cyclic fatty acids (cyFA), a gene that provides the cyclic precursor cyclohexylcarbonyl-CoA (CHC-CoA) (Cropp et al., *Nature Biotech.* 18:980-983, 2000) can be introduced and expressed in the host cell. Non-limiting examples of genes that provide CHC-CoA in *E. coli* include: ansJ, ansK, ansL, chcA, and ansM from the ansatrienin gene cluster of *Streptomyces collinus* (Chen et al., *Eur. J. Biochem.* 261: 98-107, 1999) or plmJ, plmK, plmL, chcA, and plmM from the phoslactomycin B gene cluster of *Streptomyces* sp. HK803 (Palaniappan et al., *J. Biol. Chem.* 278:35552-35557, 2003) together with the chcB gene (Patton et al., *Biochem.* 39:7595-7604, 2000) from *S. collinus, S. avermifilis*, or *S. coelicolor* (see Table 5). The genes listed in Table 4 can then be expressed to allow initiation and elongation of ω-cyclic fatty acids. Alternatively, the homologous genes can be isolated from microorganisms that make cyFA and expressed in a host cell (e.g., *E. coli*).

TABLE 5

Genes for the synthesis of CHC-CoA

| Organism | Gene | GenBank Accession # |
|---|---|---|
| *Streptomyces collinus* | ansJK | U72144* |
| | ansL | |
| | chcA | |
| | ansM | |
| | chcB | AF268489 |
| *Streptomyces* sp. HK803 | pmlJK | AAQ84158 |
| | pmlL | AAQ84159 |
| | chcA | AAQ84160 |
| | pmlM | AAQ84161 |
| *Streptomyces coelicolor* | chcB/caiD | NP_629292 |
| *Streptomyces avermitilis* | chcB/caiD | NP_629292 |

*Only chcA is annotated in GenBank entry U72144, ansJKLM are according to Chen et al. (*Eur. J. Biochem.* 261: 98-107, 1999).

The genes listed in Table 4 (fabH, acp, and fabF) allow initiation and elongation of ω-cyclic fatty acids because they have broad substrate specificity. If the coexpression of any of these genes with the genes listed in Table 5 does not yield cyFA, then fabH, acp, and/or fabF homologs from microorganisms that make cyFAs (e.g., those listed in Table 6) can be isolated (e.g., by using degenerate PCR primers or heterologous DNA sequence probes) and coexpressed.

TABLE 6

Non-limiting examples of microorganisms that contain ω-cyclic fatty acids

| Organism | Reference |
|---|---|
| *Curtobacterium pusillum* | ATCC19096 |
| *Alicyclobacillus acidoterrestris* | ATCC49025 |
| *Alicyclobacillus acidocaldarius* | ATCC27009 |
| *Alicyclobacillus cycloheptanicus* * | Moore, *J. Org. Chem.* 62: pp. 2173, 1997 |

* Uses cycloheptylcarbonyl-CoA and not cyclohexylcarbonyl-CoA as precursor for cyFA biosynthesis.

Fatty Aldehyde Saturation Levels

The degree of saturation in fatty acids can be controlled by regulating the degree of saturation of fatty acid intermediates. For example, the sfa, gns, and fab families of genes can be expressed, overexpressed, or expressed at reduced levels, to control the saturation of fatty acids. FIG. 5 lists non-limiting examples of genes in these gene families that may be used in the methods and host cells described herein. FIG. 6 lists additional fabA related genes, and FIG. 7 lists additional fabB related genes.

For example, host cells can be engineered to produce unsaturated fatty acids by engineering the production host to overexpress fabB or by growing the production host at low temperatures (e.g., less than 37° C.). FabB has preference to cis-δ3decenoyl-ACP and results in unsaturated fatty acid production in *E. coli*. Overexpression of fabB results in the production of a significant percentage of unsaturated fatty acids (de Mendoza et al., *J. Biol. Chem.* 258:2098-2101, 1983). The gene fabB may be inserted into and expressed in host cells not naturally having the gene. These unsaturated fatty acids can then be used as intermediates in host cells that are engineered to produce fatty acid derivatives, such as fatty aldehydes.

In other instances, a repressor of fatty acid biosynthesis, for example, fabR (GenBank accession NP_418398), can be deleted, which will also result in increased unsaturated fatty acid production in *E. coli* (Zhang et al., *J. Biol. Chem.* 277: 15558, 2002). Similar deletions may be made in other host cells. A further increase in unsaturated fatty acids may be achieved, for example, by overexpressing fabM (trans-2, cis-3-decenoyl-ACP isomerase, GenBank accession DAA05501) and controlled expression of fabK (trans-2-enoyl-ACP reductase II, GenBank accession NP_357969) from *Streptococcus pneumoniae* (Marrakchi et al., *J. Biol. Chem.* 277: 44809, 2002), while deleting *E. coli* fabI (trans-2-enoyl-ACP reductase, GenBank accession NP_415804). In some examples, the endogenous fabF gene can be attenuated, thus increasing the percentage of palmitoleate (C16:1) produced.

In yet other examples, host cells can be engineered to produce saturated fatty acids by reducing the expression of an sfa, gns, and/or fab gene.

In some instances, a host cell can be engineered to express an attenuated level of a dehydratase/isomerase and/or a ketoacyl-ACP synthase. For example, a host cell can be engineered to express a decreased level of fabA, fabB, a gene listed in FIG. 6, and/or a gene listed in FIG. 7. In some instances, the host cell can be grown in the presence of unsaturated fatty acids. In other instances, the host cell can be further engineered to express or overexpress a gene encoding a desaturase enzyme. One nonlimiting example of a desaturase is *B. subtilis* DesA (AF037430). Other genes encoding desaturase enzymes are known in the art and can be used in the host cells and methods described herein, such as desaturases that use acyl-ACP, such as hexadecanoyl-ACP or octadecanoyl-ACP. The saturated fatty acids can be used to produce fatty acid derivatives, such as fatty aldehydes, as described herein.

Genetic Engineering of Host Cells to Produce Fatty Aldehydes

Various host cells can be used to produce fatty aldehydes, as described herein. A host cell can be any prokaryotic or eukaryotic cell. For example, a polypeptide described herein can be expressed in bacterial cells (such as *E. coli*), insect cells, yeast, or mammalian cells (such as Chinese hamster ovary cells (CHO) cells, COS cells, VERO cells, BHK cells, HeLa cells, Cv1 cells, MDCK cells, 293 cells, 3T3 cells, or PC12 cells). Other exemplary host cells include cells from the members of the genus *Escherichia, Bacillus, Lactobacillus, Rhodococcus, Pseudomonas, Aspergillus, Trichoderma, Neurospora, Fusarium, Humicola, Rhizomucor, Kluyveromyces, Pichia, Mucor, Myceliophtora, Penicillium, Phanerochaete, Pleurotus, Trametes, Chrysosporium, Saccharomyces, Schizosaccharomyces, Yarrowia*, or *Streptomyces*. Yet other exemplary host cells can be a *Bacillus lentus* cell, a *Bacillus brevis* cell, a *Bacillus stearothermophilus* cell, a *Bacillus licheniformis* cell, a *Bacillus alkalophilus* cell, a *Bacillus coagulans* cell, a *Bacillus circulans* cell, a *Bacillus pumilis* cell, a *Bacillus thuringiensis* cell, a *Bacillus clausii* cell, a *Bacillus megaterium* cell, a *Bacillus subtilis* cell, a *Bacillus amyloliquefaciens* cell, a *Trichoderma koningii* cell, a *Trichoderma viride* cell, a *Trichoderma reesei* cell, a *Trichoderma longibrachiatum* cell, an *Aspergillus awamori* cell, an *Aspergillus* fumigates cell, an *Aspergillus foetidus* cell, an *Aspergillus nidulans* cell, an *Aspergillus niger* cell, an *Aspergillus oryzae* cell, a *Humicola insolens* cell, a *Humicola lanuginose* cell, a *Rhizomucor miehei* cell, a *Mucor michei* cell, a *Streptomyces lividans* cell, a *Streptomyces murinus* cell, or an *Actinomycetes* cell. Other host cells are cyanobacterial host cells.

In a preferred embodiment, the host cell is an *E. coli* cell, a *Saccharomyces cerevisiae* cell, or a *Bacillus subtilis* cell. In a more preferred embodiment, the host cell is from *E. coli* strains B, C, K, or W. Other suitable host cells are known to those skilled in the art.

Additional host cells that can be used in the methods described herein are described in WO2009/111513 and WO2009/111672.

Various methods well known in the art can be used to genetically engineer host cells to produce fatty aldehydes. The methods can include the use of vectors, preferably expression vectors, containing a nucleic acid encoding a fatty aldehyde biosynthetic polypeptide described herein, polypeptide variant, or a fragment thereof. Those skilled in the art will appreciate a variety of viral vectors (for example, retroviral vectors, lentiviral vectors, adenoviral vectors, and adeno-associated viral vectors) and non-viral vectors can be used in the methods described herein.

The recombinant expression vectors described herein include a nucleic acid described herein in a form suitable for expression of the nucleic acid in a host cell. The recombinant expression vectors can include one or more control sequences, selected on the basis of the host cell to be used for expression. The control sequence is operably linked to the nucleic acid sequence to be expressed. Such control sequences are described, for example, in Goeddel, Gene Expression Technology: Methods in Enzymology 185, Academic Press, San Diego, Calif. (1990). Control sequences include those that direct constitutive expression of a nucleotide sequence in many types of host cells and those that direct expression of the nucleotide sequence only in certain host cells (e.g., tissue-specific regulatory sequences). It will be appreciated by those skilled in the art that the design of the expression vector can depend on such factors as the choice of the host cell to be transformed, the level of expression of protein desired, etc. The expression vectors described herein can be introduced into host cells to produce polypeptides, including fusion polypeptides, encoded by the nucleic acids as described herein.

Recombinant expression vectors can be designed for expression of a fatty aldehyde biosynthetic polypeptide or variant in prokaryotic or eukaryotic cells (e.g., bacterial cells, such as *E. coli*, insect cells (e.g., using baculovirus expression vectors), yeast cells, or mammalian cells). Suitable host cells are discussed further in Goeddel, Gene Expression Technology: Methods in Enzymology 185, Academic Press, San Diego, Calif. (1990). Alternatively, the recombinant expression vector can be transcribed and translated in vitro, for example, by using T7 promoter regulatory sequences and T7 polymerase.

Expression of polypeptides in prokaryotes, for example, *E. coli*, is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide. Such fusion vectors typically serve three purposes: (1) to increase expression of the recombinant polypeptide; (2) to increase the solubility of the recombinant polypeptide; and (3) to aid in the purification of the recombinant polypeptide by acting as a ligand in affinity purification. Often, in fusion expression vectors, a proteolytic cleavage site is introduced at the junction of the fusion moiety and the recombinant polypeptide. This enables separation of the recombinant polypeptide from the fusion moiety after purification of the fusion polypeptide. Examples of such enzymes, and their cognate recognition sequences, include Factor Xa, thrombin, and enterokinase. Exemplary fusion expression vectors include pGEX (Pharmacia Biotech Inc; Smith et al., *Gene* (1988) 67:31-40), pMAL (New England Biolabs, Beverly, Mass.), and pRITS (Pharmacia, Piscataway, N.J.), which fuse glutathione S-transferase (GST), maltose E binding protein, or protein A, respectively, to the target recombinant polypeptide.

Examples of inducible, non-fusion *E. coli* expression vectors include pTrc (Amann et al., *Gene* (1988) 69:301-315) and pET 11d (Studier et al., Gene Expression Technology: Methods in Enzymology 185, Academic Press, San Diego, Calif. (1990) 60-89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident λ prophage harboring a T7 gn1 gene under the transcriptional control of the lacUV 5 promoter.

One strategy to maximize recombinant polypeptide expression is to express the polypeptide in a host cell with an impaired capacity to proteolytically cleave the recombinant polypeptide (see Gottesman, Gene Expression Technology: Methods in Enzymology 185, Academic Press, San Diego, Calif. (1990) 119-128). Another strategy is to alter the nucleic acid sequence to be inserted into an expression vector so that the individual codons for each amino acid are those preferentially utilized in the host cell (Wada et al., *Nucleic Acids Res.* (1992) 20:2111-2118). Such alteration of nucleic acid sequences can be carried out by standard DNA synthesis techniques.

In another embodiment, the host cell is a yeast cell. In this embodiment, the expression vector is a yeast expression vector. Examples of vectors for expression in yeast *S. cerevisiae* include pYepSec1 (Baldari et al., *EMBO J.* (1987) 6:229-234), pMFa (Kurjan et al., *Cell* (1982) 30:933-943), pJRY 88 (Schultz et al., *Gene* (1987) 54:113-123), pYES2 (Invitrogen Corporation, San Diego, Calif.), and picZ (Invitrogen Corp, San Diego, Calif.).

Alternatively, a polypeptide described herein can be expressed in insect cells using baculovirus expression vectors. Baculovirus vectors available for expression of proteins in cultured insect cells (e.g., Sf9 cells) include, for example, the pAc series (Smith et al., *Mol. Cell. Biol.* (1983) 3:2156-2165) and the pVL series (Lucklow et al., *Virology* (1989) 170:31-39).

In yet another embodiment, the nucleic acids described herein can be expressed in mammalian cells using a mammalian expression vector. Examples of mammalian expression vectors include pCDM8 (Seed, *Nature* (1987) 329:840) and pMT2PC (Kaufman et al., *EMBO J.* (1987) 6:187-195). When used in mammalian cells, the expression vector's control functions can be provided by viral regulatory elements. For example, commonly used promoters are derived from polyoma, Adenovirus 2, cytomegalovirus, and Simian Virus 40. Other suitable expression systems for both prokaryotic and eukaryotic cells are described in chapters 16 and 17 of Sambrook et al., eds., Molecular Cloning: A Laboratory Manual. 2nd, ed., Cold Spring Harbor Laboratory, Cold Spring Harbor Laboratory Press, Cold Spring Harbor, N.Y., 1989.

Vectors can be introduced into prokaryotic or eukaryotic cells via conventional transformation or transfection techniques. As used herein, the terms "transformation" and "transfection" refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in, for example, Sambrook et al. (supra).

For stable transformation of bacterial cells, it is known that, depending upon the expression vector and transformation technique used, only a small fraction of cells will take-up and replicate the expression vector. In order to identify and select these transformants, a gene that encodes a selectable marker (e.g., resistance to antibiotics) can be introduced into the host cells along with the gene of interest. Selectable markers include those that confer resistance to drugs, such as ampicillin, kanamycin, chloramphenicol, or tetracycline. Nucleic acids encoding a selectable marker can be introduced into a host cell on the same vector as that encoding a polypeptide described herein or can be introduced on a separate vector. Cells stably transfected with the introduced nucleic acid can be identified by drug selection (e.g., cells that have incorporated the selectable marker gene will survive, while the other cells die).

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) can be introduced into the host cells along with the gene of interest. Preferred selectable markers include those which confer resistance to drugs, such as G418, hygromycin, and methotrexate. Nucleic acids encoding a selectable marker can be introduced into a host cell on the same vector as that encoding a polypeptide described herein or can be introduced on a separate vector. Cells stably transfected with the introduced nucleic acid can be identified by drug selection (e.g., cells that have incorporated the selectable marker gene will survive, while the other cells die).

Transport Proteins

Transport proteins can export polypeptides and organic compounds (e.g., fatty aldehydes) out of a host cell. Many transport and efflux proteins serve to excrete a wide variety of compounds and can be naturally modified to be selective for particular types of hydrocarbons.

Non-limiting examples of suitable transport proteins are ATP-Binding Cassette (ABC) transport proteins, efflux proteins, and fatty acid transporter proteins (FATP). Additional non-limiting examples of suitable transport proteins include the ABC transport proteins from organisms such as *Caenorhabditis elegans, Arabidopsis thalania, Alkaligenes eutrophus*, and *Rhodococcus erythropolis*. Exemplary ABC transport proteins that can be used are listed in FIG. 5 (e.g., CER5, AtMRP5, AmiS2, and AtPGP1). Host cells can also be chosen for their endogenous ability to secrete organic compounds. The efficiency of organic compound production and secretion into the host cell environment (e.g., culture medium, fermentation broth) can be expressed as a ratio of intracellular product to extracellular product. In some examples, the ratio can be about 5:1, 4:1, 3:1, 2:1, 1:1, 1:2, 1:3, 1:4, or 1:5.

Fermentation

The production and isolation of fatty aldehydes can be enhanced by employing beneficial fermentation techniques. One method for maximizing production while reducing costs is increasing the percentage of the carbon source that is converted to hydrocarbon products.

During normal cellular lifecycles, carbon is used in cellular functions, such as producing lipids, saccharides, proteins, organic acids, and nucleic acids. Reducing the amount of carbon necessary for growth-related activities can increase the efficiency of carbon source conversion to product. This can be achieved by, for example, first growing host cells to a desired density (for example, a density achieved at the peak of the log phase of growth). At such a point, replication checkpoint genes can be harnessed to stop the growth of cells. Specifically, quorum sensing mechanisms (reviewed in Camilli et al., *Science* 311:1113, 2006; Venturi *FEMS Microbio. Rev.* 30:274-291, 2006; and Reading et al., *FEMS Microbiol. Lett.* 254:1-11, 2006) can be used to activate checkpoint genes, such as p53, p21, or other checkpoint genes.

Genes that can be activated to stop cell replication and growth in *E. coli* include umuDC genes. The overexpression of umuDC genes stops the progression from stationary phase to exponential growth (Murli et al., *J. of Bact.* 182:1127, 2000). UmuC is a DNA polymerase that can carry out translesion synthesis over non-coding lesions—the mechanistic basis of most UV and chemical mutagenesis. The umuDC gene products are involved in the process of translesion synthesis and also serve as a DNA sequence damage checkpoint. The umuDC gene products include UmuC, UmuD, umuD', $UmuD'_2C$, $UmuD'_2$, and $UmuD_2$. Simultaneously, product-producing genes can be activated, thus minimizing the need for replication and maintenance pathways to be used while a fatty aldehyde is being made. Host cells can also be engineered to express umuC and umuD from *E. coli* in pBAD24 under the prpBCDE promoter system through de novo synthesis of this gene with the appropriate end-product production genes.

The percentage of input carbons converted to fatty aldehydes can be a cost driver. The more efficient the process is (i.e., the higher the percentage of input carbons converted to fatty aldehydes), the less expensive the process will be. For oxygen-containing carbon sources (e.g., glucose and other carbohydrate based sources), the oxygen must be released in the form of carbon dioxide. For every 2 oxygen atoms released, a carbon atom is also released leading to a maximal theoretical metabolic efficiency of approximately 34% (w/w) (for fatty acid derived products). This figure, however, changes for other organic compounds and carbon sources. Typical efficiencies in the literature are approximately less than 5%. Host cells engineered to produce fatty aldehydes can have greater than about 1, 3, 5, 10, 15, 20, 25, and 30% efficiency. In one example, host cells can exhibit an efficiency of about 10% to about 25%. In other examples, such host cells can exhibit an efficiency of about 25% to about 30%. In other examples, host cells can exhibit greater than 30% efficiency.

The host cell can be additionally engineered to express recombinant cellulosomes, such as those described in PCT application number PCT/US2007/003736. These cellulosomes can allow the host cell to use cellulosic material as a carbon source. For example, the host cell can be additionally engineered to express invertases (EC 3.2.1.26) so that sucrose can be used as a carbon source. Similarly, the host cell can be engineered using the teachings described in U.S. Pat. Nos. 5,000,000; 5,028,539; 5,424,202; 5,482,846; and 5,602,030; so that the host cell can assimilate carbon efficiently and use cellulosic materials as carbon sources.

In one example, the fermentation chamber can enclose a fermentation that is undergoing a continuous reduction. In this instance, a stable reductive environment can be created. The electron balance can be maintained by the release of carbon dioxide (in gaseous form). Efforts to augment the NAD/H and NADP/H balance can also facilitate in stabilizing the electron balance. The availability of intracellular NADPH can also be enhanced by engineering the host cell to express an NADH:NADPH transhydrogenase. The expression of one or more NADH:NADPH transhydrogenases converts the NADH produced in glycolysis to NADPH, which can enhance the production of fatty aldehydes.

For small scale production, the engineered host cells can be grown in batches of, for example, about 100 mL, 500 mL, 1 L, 2 L, 5 L, or 10 L; fermented; and induced to express desired fatty aldehyde biosynthetic genes based on the specific genes encoded in the appropriate plasmids. For large scale production, the engineered host cells can be grown in batches of about 10 L, 100 L, 1000 L, 10,000 L, 100,000 L, 1,000,000 L or larger; fermented; and induced to express desired fatty aldehyde biosynthetic genes based on the specific genes encoded in the appropriate plasmids or incorporated into the host cell's genome.

For example, a suitable production host, such as *E. coli* cells, harboring plasmids containing the desired fatty aldehyde biosynthetic genes or having the fatty aldehyde biosynthetic genes integrated in its chromosome can be incubated in a suitable reactor, for example a 1 L reactor, for 20 hours at 37° C. in M9 medium supplemented with 2% glucose, carbenicillin, and chloramphenicol. When the $OD_{600}$ of the culture reaches 0.9, the production host can be induced with IPTG to activate the engineered gene systems for fatty aldehyde production. After incubation, the spent media can be extracted and the organic phase can be examined for the presence of fatty aldehydes using GC-MS.

In some instances, after the first hour of induction, aliquots of no more than about 10% of the total cell volume can be removed each hour and allowed to sit without agitation to allow the fatty aldehydes to rise to the surface and undergo a spontaneous phase separation or precipitation. The fatty aldehyde component can then be collected, and the aqueous phase returned to the reaction chamber. The reaction chamber can be operated continuously. When the $OD_{600}$ drops below 0.6, the cells can be replaced with a new batch grown from a seed culture.

Producing Fatty Aldehydes Using Cell-Free Methods

In some methods described herein, a fatty aldehyde can be produced using a purified polypeptide described herein and a substrate described herein. For example, a host cell can be engineered to express a fatty aldehyde biosynthetic polypeptide or variant as described herein. The host cell can be cultured under conditions suitable to allow expression of the polypeptide. Cell free extracts can then be generated using known methods. For example, the host cells can be lysed using detergents or by sonication. The expressed polypeptides can be purified using known methods. After obtaining the cell free extracts, substrates described herein can be added to the cell free extracts and maintained under conditions to allow conversion of the substrates to fatty aldehydes. The fatty aldehydes can then be separated and purified using known techniques.

Post-Production Processing

The fatty aldehydes produced during fermentation can be separated from the fermentation media. Any known technique for separating fatty aldehydes from aqueous media can be used. One exemplary separation process is a two phase (bi-phasic) separation process. This process involves fermenting the genetically engineered host cells under conditions sufficient to produce a fatty aldehyde, allowing the fatty aldehyde to collect in an organic phase, and separating the organic phase from the aqueous fermentation broth. This method can be practiced in both a batch and continuous fermentation processes.

Bi-phasic separation uses the relative immiscibility of fatty aldehydes to facilitate separation. Immiscible refers to the relative inability of a compound to dissolve in water and is defined by the compound's partition coefficient. One of ordinary skill in the art will appreciate that by choosing a fermentation broth and organic phase, such that the fatty aldehyde being produced has a high log P value, the fatty aldehyde can separate into the organic phase, even at very low concentrations, in the fermentation vessel.

The fatty aldehydes produced by the methods described herein can be relatively immiscible in the fermentation broth, as well as in the cytoplasm. Therefore, the fatty aldehyde can collect in an organic phase either intracellularly or extracellularly. The collection of the products in the organic phase can lessen the impact of the fatty aldehyde on cellular function and can allow the host cell to produce more product.

The methods described herein can result in the production of homogeneous compounds wherein at least about 60%, 70%, 80%, 90%, or 95% of the fatty aldehydes produced will have carbon chain lengths that vary by less than about 6 carbons, less than about 4 carbons, or less than about 2 carbons. These compounds can also be produced with a relatively uniform degree of saturation. These compounds can be used directly as fuels, fuel additives, starting materials for production of other chemical compounds (e.g., polymers, surfactants, plastics, textiles, solvents, adhesives, etc.), or personal care additives. These compounds can also be used as feedstock for subsequent reactions, for example, hydrogenation, catalytic cracking (e.g., via hydrogenation, pyrolysis, or both), to make other products.

In some embodiments, the fatty aldehydes produced using methods described herein can contain between about 50% and about 90% carbon; or between about 5% and about 25% hydrogen. In other embodiments, the fatty aldehydes produced using methods described herein can contain between about 65% and about 85% carbon; or between about 10% and about 15% hydrogen.

Bioproducts

Bioproducts (e.g., fatty aldehydes) comprising biologically produced organic compounds, particularly fatty aldehydes biologically produced using the fatty acid biosynthetic pathway, have not been produced from renewable sources and, as such, are new compositions of matter. These new bioproducts can be distinguished from organic compounds derived from petrochemical carbon on the basis of dual carbon-isotopic fingerprinting or $^{14}C$ dating. Additionally, the specific source of biosourced carbon (e.g., glucose vs. glycerol) can be determined by dual carbon-isotopic fingerprinting (see, e.g., U.S. Pat. No. 7,169,588, which is herein incorporated by reference).

The ability to distinguish bioproducts from petroleum based organic compounds is beneficial in tracking these materials in commerce. For example, organic compounds or chemicals comprising both biologically based and petroleum based carbon isotope profiles may be distinguished from organic compounds and chemicals made only of petroleum based materials. Hence, the instant materials may be followed in commerce on the basis of their unique carbon isotope profile.

Bioproducts can be distinguished from petroleum based organic compounds by comparing the stable carbon isotope ratio ($^{13}C/^{12}C$) in each fuel. The $^{13}C/^{12}C$ ratio in a given bioproduct is a consequence of the $^{13}C/^{12}C$ ratio in atmospheric carbon dioxide at the time the carbon dioxide is fixed. It also reflects the precise metabolic pathway. Regional variations also occur. Petroleum, $C_3$ plants (the broadleaf), $C_4$ plants (the grasses), and marine carbonates all show significant differences in $^{13}C/^{12}C$ and the corresponding $\delta^{13}C$ values. Furthermore, lipid matter of $C_3$ and $C_4$ plants analyze differently than materials derived from the carbohydrate components of the same plants as a consequence of the metabolic pathway.

Within the precision of measurement, $^{13}C$ shows large variations due to isotopic fractionation effects, the most significant of which for bioproducts is the photosynthetic mechanism. The major cause of differences in the carbon isotope ratio in plants is closely associated with differences in the pathway of photosynthetic carbon metabolism in the plants, particularly the reaction occurring during the primary carboxylation (i.e., the initial fixation of atmospheric $CO_2$). Two large classes of vegetation are those that incorporate the "$C_3$" (or Calvin-Benson) photosynthetic cycle and those that incorporate the "$C_4$" (or Hatch-Slack) photosynthetic cycle.

In $C_3$ plants, the primary $CO_2$ fixation or carboxylation reaction involves the enzyme ribulose-1,5-diphosphate carboxylase, and the first stable product is a 3-carbon compound. $C_3$ plants, such as hardwoods and conifers, are dominant in the temperate climate zones.

In $C_4$ plants, an additional carboxylation reaction involving another enzyme, phosphoenol-pyruvate carboxylase, is the primary carboxylation reaction. The first stable carbon compound is a 4-carbon acid that is subsequently decarboxylated. The $CO_2$ thus released is refixed by the $C_3$ cycle. Examples of $C_4$ plants are tropical grasses, corn, and sugar cane.

Both $C_4$ and $C_3$ plants exhibit a range of $^{13}C/^{12}C$ isotopic ratios, but typical values are about −7 to about −13 per mil for $C_4$ plants and about −19 to about −27 per mil for $C_3$ plants (see, e.g., Stuiver et al., *Radiocarbon* 19:355, 1977). Coal and petroleum fall generally in this latter range. The $^{13}C$ measurement scale was originally defined by a zero set by Pee Dee Belemnite (PDB) limestone, where values are given in parts per thousand deviations from this material. The "$\delta^{13}C$" values are expressed in parts per thousand (per mil), abbreviated, ‰, and are calculated as follows:

$$\delta^{13}C(‰)=[(^{13}C/^{12}C)_{sample}-(^{13}C/^{12}C)_{standard}]/(^{13}C/^{12}C)_{standard}\times 1000$$

Since the PDB reference material (RM) has been exhausted, a series of alternative RMs have been developed in cooperation with the IAEA, USGS, NIST, and other selected international isotope laboratories. Notations for the per mil deviations from PDB is $\delta^{13}C$. Measurements are made on $CO_2$ by high precision stable ratio mass spectrometry (IRMS) on molecular ions of masses 44, 45, and 46.

The compositions described herein include bioproducts produced by any of the methods described herein. Specifically, the bioproduct can have a $\delta^{13}C$ of about −28 or greater, about −27 or greater, −20 or greater, −18 or greater, −15 or greater, −13 or greater, −10 or greater, or −8 or greater. For example, the bioproduct can have a $\delta^{13}C$ of about −30 to about −15, about −27 to about −19, about −25 to about −21, about −15 to about −5, about −13 to about −7, or about −13 to about −10. In other instances, the bioproduct can have a $\delta^{13}C$ of about −10, −11, −12, or −12.3.

Bioproducts can also be distinguished from petroleum based organic compounds by comparing the amount of $^{14}C$ in each compound. Because $^{14}C$ has a nuclear half life of 5730 years, petroleum based fuels containing "older" carbon can be distinguished from bioproducts which contain "newer" carbon (see, e.g., Currie, "Source Apportionment of Atmospheric Particles", *Characterization of Environmental Particles*, J. Buffle and H. P. van Leeuwen, Eds., 1 of Vol. I of the IUPAC Environmental Analytical Chemistry Series (Lewis Publishers, Inc) (1992) 3-74).

The basic assumption in radiocarbon dating is that the constancy of $^{14}C$ concentration in the atmosphere leads to the constancy of $^{14}C$ in living organisms. However, because of atmospheric nuclear testing since 1950 and the burning of fossil fuel since 1850, $^{14}C$ has acquired a second, geochemical time characteristic. Its concentration in atmospheric $CO_2$, and hence in the living biosphere, approximately doubled at the peak of nuclear testing, in the mid-1960s. It has since been gradually returning to the steady-state cosmogenic (atmospheric) baseline isotope rate ($^{14}C/^{12}C$) of about $1.2\times10^{-12}$, with an approximate relaxation "half-life" of 7-10 years. (This latter half-life must not be taken literally; rather, one must use the detailed atmospheric nuclear input/decay function to trace the variation of atmospheric and biospheric $^{14}C$ since the onset of the nuclear age.)

It is this latter biospheric $^{14}C$ time characteristic that holds out the promise of annual dating of recent biospheric carbon. $^{14}C$ can be measured by accelerator mass spectrometry (AMS), with results given in units of "fraction of modern carbon" ($f_M$). $f_M$ is defined by National Institute of Standards and Technology (NIST) Standard Reference Materials (SRMs) 4990B and 4990C. As used herein, "fraction of modern carbon" or "$f_M$" has the same meaning as defined by National Institute of Standards and Technology (NIST) Standard Reference Materials (SRMs) 4990B and 4990C, known as oxalic acids standards HOxI and HOxII, respectively. The fundamental definition relates to 0.95 times the $^{14}C/^{12}C$ isotope ratio HOxI (referenced to AD 1950). This is roughly equivalent to decay-corrected pre-Industrial Revolution wood. For the current living biosphere (plant material), $f_M$ is approximately 1.1.

The invention provides a bioproduct which can have an $f_M{}^{14}C$ of at least about 1. For example, the bioproduct can have an $f_M{}^{14}C$ of at least about 1.01, an $f_M{}^{14}C$ of about 1 to about 1.5, an $f_M{}^{14}C$ of about 1.04 to about 1.18, or an $f_M{}^{14}C$ of about 1.111 to about 1.124.

Another measurement of $^{14}C$ is known as the percent of modern carbon, pMC. For an archaeologist or geologist using $^{14}C$ dates, AD 1950 equals "zero years old". This also represents 100 pMC. "Bomb carbon" in the atmosphere reached almost twice the normal level in 1963 at the peak of thermonuclear weapons. Its distribution within the atmosphere has been approximated since its appearance, showing values that are greater than 100 pMC for plants and animals living since AD 1950. It has gradually decreased over time with today's value being near 107.5 pMC. This means that a fresh biomass material, such as corn, would give a $^{14}C$ signature near 107.5 pMC. Petroleum based compounds will have a pMC value of zero. Combining fossil carbon with present day carbon will result in a dilution of the present day pMC content. By presuming 107.5 pMC represents the $^{14}C$ content of present day biomass materials and 0 pMC represents the $^{14}C$ content of petroleum based products, the measured pMC value for that material will reflect the proportions of the two component types. For example, a material derived 100% from present day soybeans would give a radiocarbon signature near 107.5 pMC. If that material was diluted 50% with petroleum based products, it would give a radiocarbon signature of approximately 54 pMC.

A biologically based carbon content is derived by assigning "100%" equal to 107.5 pMC and "0%" equal to 0 pMC. For example, a sample measuring 99 pMC will give an equivalent biologically based carbon content of 93%. This value is referred to as the mean biologically based carbon result and assumes all the components within the analyzed material originated either from present day biological material or petroleum based material.

A bioproduct described herein can have a pMC of at least about 50, 60, 70, 75, 80, 85, 90, 95, 96, 97, 98, 99, or 100. In other instances, a bioproduct described herein can have a pMC of between about 50 and about 100; about 60 and about 100; about 70 and about 100; about 80 and about 100; about 85 and about 100; about 87 and about 98; or about 90 and about 95. In yet other instances, a bioproduct described herein can have a pMC of about 90, 91, 92, 93, 94, or 94.2.

The invention is further illustrated by the following examples. The examples are provided for illustrative purposes only. They are not to be construed as limiting the scope or content of the invention in any way.

EXAMPLES

Example 1

Identification of Carboxylic Acid Reductase (CAR) Homologs

The carboxylic acid reductase (CAR) from *Nocardia* sp. strain NRRL 5646 can reduce carboxylic acids into corresponding aldehydes without separate activating enzymes, such as acyl-CoA synthases (Li et al., *J. Bacteriol.* 179:3482-3487, 1997; He et al., *Appl. Environ. Microbiol.* 70:1874-1881, 2004)). A BLAST search using the NRRL 5646 CAR amino acid sequence (Genpept accession AAR91681) (SEQ ID NO:16) as the query sequence identified approximately 20 homologous sequences. Three homologs, listed in Table 7, were evaluated for their ability to convert fatty acids into fatty aldehydes in vivo when expressed in *E. coli*. At the nucleotide sequence level, carA (SEQ ID NO:19), carB (SEQ ID NO:21), and fadD9 (SEQ ID NO:17) demonstrated 62.6%, 49.4%, and 60.5% homology, respectively, to the car gene (AY495697) of *Nocardia* sp. NRRL 5646 (SEQ ID NO:15). At the amino acid level, CARA (SEQ ID NO:20), CARB (SEQ ID NO:22), and FadD9 (SEQ ID NO:18) demonstrated 62.4%, 59.1% and 60.7% identity, respectively, to CAR of *Nocardia* sp. NRRL 5646 (SEQ ID NO:16).

TABLE 7

CAR-like Protein and the corresponding coding sequences.

| Genpept accession | Locus_tag | Annotation in GenBank | Gene name |
|---|---|---|---|
| NP_217106 | Rv 2590 | Probable fatty-acid-CoA ligase (FadD9) | fadD9 |
| ABK75684 | MSMEG 2956 | NAD dependent epimerase/dehydratase family protein | carA |
| YP_889972.1 | MSMEG 5739 | NAD dependent epimerase/dehydratase family protein | carB |

Example 2

Expression of CAR Homologs in *E. coli*

A. Plasmid Construction

Three *E. coli* expression plasmids were constructed to express the genes encoding the CAR homologs listed in Table 7. First, fadD9 was amplified from genomic DNA of *Mycobacterium tuberculosis* H37Rv (obtained from The University of British Columbia, and Vancouver, BC Canada) using the primers fadD9F and FadDR (see Table 8). The PCR product was first cloned into PCR-blunt (Invitrogen) and then released as an NdeI-AvrII fragment. The NdeI-AvrII fragment was then cloned between the NdeI and AvrII sites of pACYCDuet-1 (Novogen) to generate pACYCDuet-1-fadD9.

The carA and carB genes were amplified from the genomic DNA of *Mycobacterium smegmatis* MC2 155 (obtained from the ATCC (ATCC 23037D-5)) using primers CARMCaF and CARMCaR or CARMCbF and CARMCbR, respectively (see Table 8). Each PCR product was first cloned into PCR-blunt and then released as an NdeI-AvrII fragment. Each of the two fragments was then subcloned between the NdeI and AvrII sites of pACYCDuet-1 (Novogen) to generate pACYC-DUET-carA and pACYCDUET-carB.

TABLE 8

Primers used to amplify genes encoding CAR homologs

| | |
|---|---|
| fadD9F | cat ATGTCGATCAACGATCAGCGACTGAC (SEQ ID NO: 1) |
| fadD9R | cctagg TCACAGCAGCCCGAGCAGTC (SEQ ID NO: 2) |
| CARMCaF | cat ATGACGATCGAAACGCG (SEQ ID NO: 3) |
| CARMCaR | cctagg TTACAGCAATCCGAGCATCT (SEQ ID NO: 4) |
| CARMCbF | cat ATGACCAGCGATGTTCAC (SEQ ID NO: 5) |
| CARMCbR | cctagg TCAGATCAGACCGAACTCACG (SEQ ID NO: 6) |

B. Evaluation of Fatty Aldehyde Production

Plasmids encoding the CAR homologs (pACYCDUET-fadD9, pACYCDUET-carA, and pACYCDUET-carB) were separately co-transformed into the *E. coli* strain C41 (DE3, AfadE) (described in PCT/US08/058788) together with pET-Duet-1-'tesA (described in PCT/US08/058788).

The *E. coli* transformants were grown in 3 mL of LB medium supplemented with carbenicillin (100 mg/L) and chloramphenicol (34 mg/L) at 37° C. After overnight growth, 15 μL of culture was transferred into 2 mL of fresh LB medium supplemented with carbenicillin and chloramphenicol. After 3.5 hours of growth, 2 mL of culture were transferred into a 125 mL flask containing 20 mL of M9 medium with 2% glucose and with carbenicillin and chloramphenicol. When the $OD_{600}$ of the culture reached 0.9, 1 mM of IPTG was added to each flask. After 20 hours of growth at 37° C., 20 mL of ethyl acetate (with 1% of acetic acid, v/v) was added to each flask to extract the organic compounds produced during the fermentation. The crude ethyl acetate extract was directly analyzed with GC/MS as described below.

The co-expression of the leaderless 'tesA and any of the three car genes in *E. coli* resulted in detectable fatty aldehyde production. In one fermentation, LS9001/pACYCDUET carB+pETDuet-1-'tesA produced an average of 120 mg/L of fatty aldehydes. The retention times were 6.959 minutes for dodecanal, 8.247 minutes for 7-tetradecenal, 8.37 minutes for tetradecanal, 9.433 minutes for 9-hexadecenal, 9.545 minutes for hexadecanal, and 10.945 minutes for 11-octadecenal. The presence of large amounts of fatty aldehydes is consistent with CAR being an aldehyde-generating, fatty acid reductase (AFAR). This mechanism is different from the alcohol-generating fatty acyl-CoA reductases (FAR), for example, JjFAR, and fatty acyl-CoA reductases, such as Acr1.

C. Substrate Preferences of the CAR Homologs

Distinct substrate preferences were observed among the three CAR homologs evaluated. FadD9 exhibited a strong preference for $C_{12}$ fatty acids relative to other fatty acids with carbon chain lengths greater than 12. Both CarA and CarB demonstrated wider substrate ranges than FadD9.

D. Quantification and Identification of Fatty Aldehydes

GC-MS was performed using an Agilent 5975B MSD system equipped with a 30 m×0.25 mm (0.10 μm film) DB-5 column. The column temperature was 3 min isothermal at 100° C. The column was programmed to rise from 100° C. to 320° C. at a rate of 20° C./min. When the final temperature was reached, the column remained isothermal for 5 minutes at 320° C. The injection volume was 1 μL. The carrier gas, helium, was released at 1.3 mL/min. The mass spectrometer was equipped with an electron impact ionization source. The ionization source temperature was set at 300° C.

Prior to quantification, various aldehydes were identified using two methods. First, the GC retention time of each compound was compared to the retention time of a known standard, such as laurylaldehyde (dodecanal). Second, identification of each compound was confirmed by matching the compound's mass spectrum to a standard's mass spectrum in the mass spectra library.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (122 sequences)

SEQ ID NO: 1 - DNA, 29 bp, Artificial Sequence
  Description of Artificial Sequence: Synthetic primer
catatgtcgatcaacgatcagcgactgac

SEQ ID NO: 2 - DNA, 26 bp, Artificial Sequence
  Description of Artificial Sequence: Synthetic primer
cctaggtcacagcagcccgagcagtc

SEQ ID NO: 3 - DNA, 20 bp, Artificial Sequence
  Description of Artificial Sequence: Synthetic primer
catatgacgatcgaaacgcg

SEQ ID NO: 4 - DNA, 26 bp, Artificial Sequence
  Description of Artificial Sequence: Synthetic primer
cctaggttacagcaatccgagcatct

SEQ ID NO: 5 - DNA, 21 bp, Artificial Sequence
  Description of Artificial Sequence: Synthetic primer
catatgaccagcgatgttcac

SEQ ID NO: 6 - DNA, 27 bp, Artificial Sequence
  Description of Artificial Sequence: Synthetic primer
cctaggtcagatcagaccgaactcacg

SEQ ID NO: 7 - protein, 7 aa, Artificial Sequence
  Description of Artificial Sequence: Synthetic peptide
  MOD_RES (3)..(4): Any amino acid
  MOD_RES (5)..(5): Ser, Ala or Thr
  MOD_RES (7)..(7): Trp or Leu
GYXXXKX

SEQ ID NO: 8 - protein, 7 aa, Artificial Sequence
  Description of Artificial Sequence: Synthetic peptide
  MOD_RES (2)..(3): Any amino acid
  MOD_RES (5)..(5): Any amino acid
GXXGXLG

SEQ ID NO: 9 - protein, 8 aa, Artificial Sequence
  Description of Artificial Sequence: Synthetic peptide
  MOD_RES (1)..(1): Leu, Val or Ile
  MOD_RES (6)..(7): Any amino acid
XGGDSXXA

SEQ ID NO: 10 - protein, 12 aa, Artificial Sequence
  Description of Artificial Sequence: Synthetic peptide
  MOD_RES (1)..(1): Leu, Ile, Val, Met, Phe or Tyr
  MOD_RES (2)..(2): Any amino acid except Glu
  MOD_RES (3)..(3): Any amino acid except Val, Glu or Ser
  MOD_RES (4)..(4): Ser, Thr or Gly
  MOD_RES (5)..(5): Ser, Thr, Ala or Gly
  MOD_RES (7)..(7): Ser or Thr
  MOD_RES (8)..(8): Ser, Thr, Glu, Ile or Ala
  MOD_RES (9)..(9): Ser or Gly
  MOD_RES (10)..(10): Any amino acid
  MOD_RES (11)..(11): Pro, Ala, Ser, Leu, Ile, Val or Met
  MOD_RES (12)..(12): Lys or Arg
XXXXXGXXXXXX

SEQ ID NO: 11 - protein, 21 aa, Artificial Sequence
  Description of Artificial Sequence: Synthetic peptide
  MOD_RES (6)..(6): Ser or Thr
  MOD_RES (9)..(9): Thr or Asn
  MOD_RES (11)..(11): Phe or Trp
  MOD_RES (15)..(15): Phe or Tyr
  MOD_RES (17)..(17): Ala or Thr
  MOD_RES (19)..(19): Glu or Gln
RTVLLXGAXGXLGRXLXLXWL

SEQ ID NO: 12 - protein, 20 aa, Artificial Sequence
  Description of Artificial Sequence: Synthetic peptide
  MOD_RES (2)..(3): Any amino acid
  MOD_RES (5)..(6): Any amino acid
  MOD_RES (8)..(8): Any amino acid
  MOD_RES (11)..(12): Any amino acid
  MOD_RES (14)..(14): Any amino acid
  MOD_RES (16)..(16): Any amino acid
  MOD_RES (19)..(19): Any amino acid
LXXGXXGXLGXXLXLXWLXR

SEQ ID NO: 13 - protein, 8 aa, Artificial Sequence
  Description of Artificial Sequence: Synthetic peptide
  MOD_RES (3)..(3): Any amino acid
WAXEVLLR

SEQ ID NO: 14 - protein, 33 aa, Artificial Sequence
  Description of Artificial Sequence: Synthetic polypeptide
  MOD_RES (2)..(3): Any amino acid
  MOD_RES (5)..(6): Any amino acid
  MOD_RES (8)..(8): Any amino acid
  MOD_RES (11)..(12): Any amino acid
  MOD_RES (14)..(14): Any amino acid
  MOD_RES (15)..(15): Leu or Ile
  MOD_RES (16)..(16): Any amino acid
  MOD_RES (17)..(17): Trp or Leu
  MOD_RES (19)..(32): Any amino acid and this region may be 13 to 14 residues in length
LXXGXXGXLGXXLXXXXLXXXXXXXXXXXXXXR

SEQ ID NO: 15 - DNA, 3525 bp, Nocardia sp.
atggcagtggattcaccggatgagcggctacagcgccgcattgcacagttgtttgcagaagatgagcaggtcaaggccgcacgtccgctcgaagcggtgagcgcggcggtgagcgcgcccggtatgcggctggcgcagatcgccgccactgttatggcgggttacgccgaccgcccggccgccgggcagcgtgcgttcgaactgaacaccgacgacgcgacgggccgcacctcgctgcggttacttccccgattcgagaccatcacctatcgcgaactgtggcagcgagtcggcgaggttgccgcggcctggcatcatgatcccgagaaccccttgcgcgcaggtgatttcgtcgccctgctcggcttcaccagcatcgactacgccaccctcgacctggccgatatccacctcggcgcggttaccgtgccgttgcaggccagcgcggcggtgtcccagctgatcgctatcctcaccgagacttcgccgcggctgctcgcctcgaccccggagcacctcgatgcggcggtcgagtgcctactcgcgggcaccacaccggaacgactggtggtcttcgactaccaccccgaggacgacgaccagcgtgcggccttcgaatccgcccgccgccgccttgccgacgcgggcagcttggtgatcgtcgaaacgctcgatgccgtgcgtgcccggggccgcgacttaccggccgcgccactgttcgttcccgacaccgacgacgacccgctggccctgctgatctacacctccggcagcaccggaacgccgaagggcgcgatgtacaccaatcggttggccgccacgatgtggcaggggaactcgatgctgcaggggaactcgcaacgggtcgggatcaatctcaactacatgccgatgagccacatcgccggtcgcatatcgctgttcggcgtgctcgctcgcggtggcaccgcatacttcgcggccaagagcgacatgtcgacactgttcgaagacatcggcttggtacgtcccaccgagatcttcttcgtcccgcgcgtgtgcgacatggtcttccagcgctatcagagcgagctggaccggcgctcggtggcgggcgccgacctggacacgctcgatcgggaagtgaaagccgacctccggcagaactacctcggtgggcgcttcctggtggcggtcgtcggcagcgcgccgctggccgcggagatgaagacgttcatggagtccgtcctcgatctgccactgcacgacgggtacgggtcgaccgaggcgggcgcaagcgtgctgctcgacaaccagatccagcggccgccggtgctcgattacaagctcgtcgacgtgcccgaactgggttacttccgcaccgaccggccgcatccgcgcggtgagctgttgttgaaggcggagaccacgattccgggctactacaagcggcccgaggtcaccgcggagatcttcgacgaggacggcttctacaagaccggcgatatcgtggccgagctcgagcacgatcggctggtctatgtcgaccgtcgcaacaatgtgctcaaactgtcgcagggcgagttcgtgaccgtcgcccatctcgaggccgtgttcgccagcagcccgctgatccggcagatcttcatctacggcagcagcgaacgttcctatctgctcgcggtgatcgtccccaccgacgacgcgctgcgcggccgcgacaccgccaccttgaaatcggcactggccgaatcgattcagcgcatcgccaaggacgcgaacctgcagccctacgagattccgcgcgatttcctgatcgagaccgagccgttcaccatcgccaacggactgctctccggcatcgcgaagctgctgcgccccaatctgaaggaacgctacggcgctcagctggagcagatgtacaccgatctcgcgacaggccaggccgatgagctgctcgccctgcgccgcgaagccgccgacctgccggtgctcgaaaccgtcagccgggcagcgaaagcgatgctcggcgtcgcctccgccgatatgcgtcccgacgcgcacttcaccgacctgggcggcgattccctttccgcgctgtcgttctcgaacctgctgcacgagatcttcggggtcgaggtgccggtgggtgtcgtcgtcagcccggcgaacgagctgcgcgatctggcgaattacattgaggcggaacgcaactcgggcgcgaagcgtcccaccttcacctcggtgcacggcggcggttccgagatccgcgccgccgatctgaccctcgacaagttcatcgatgcccgcaccctggccgccgccgacagcattccgcacgcgccggtgccagcgcagacggtgctgctgaccggcgcgaacggctacctcggccggttcctgtgcctggaatggctggagcggctggacaagacgggtggcacgctgatctgcgtcgtgcgcggtagtgacgcggccgcggcccgtaaacggctggactcggcgttcgacagcggcgatcccggcctgctcgagcactaccagcaactggccgcacggaccctggaagtcctcgccggtgatatcggcgacccgaatctcggtctggacgacgcgacttggcagcggttggccgaaaccgtcgacctgatcgtccatcccgccgcgttggtcaaccacgtccttccctacacccagctgttcggccccaatgtcgtcggcaccgccgaaatcgtccggttggcgatcacggcgcggcgcaagccggtcacctacctgtcgaccgtcggagtggccgaccaggtcgacccggcggagtatcaggaggacagcgacgtccgcgagatgagcgcggtgcgcgtcgtgcgcgagagttacgccaacggctacggcaacagcaagtgggcgggggaggtcctgctgcgcgaagcacacgatctgtgtggcttgccggtcgcggtgttccgttcggacatgatcctggcgcacagccggtacgcgggtcagctcaacgtccaggacgtgttcacccggctgatcctcagcctggtcgccaccggcatcgcgccgtactcgttctaccgaaccgacgcggacggcaaccggcagcgggcccactatgacggcttgccggcggacttcacggcggcggcgatcaccgcgctcggcatccaagccaccgaaggcttccggacctacgacgtgctcaatccgtacgacgatggcatctccctcgatgaattcgtcgactggctcgtcgaatccggccacccgatccagcgcatcaccgactacagcgactggttccaccgtttcgagacggcgatccgcgcgctgccggaaaagcaacgccaggcctcggtgctgccgttgctggacgcctaccgcaacccctgcccggcggtccgcggcgcgatactcccggccaaggagttccaagcggcggtgcaaacagccaaaatcggtccggaacaggacatcccgcatttgtccgcgccactgatcgataagtacgtcagcgatctggaactgcttcagctgctctga

SEQ ID NO: 16 - protein, 1174 aa, Nocardia sp.
MAVDSPDERLQRRIAQLFAEDEQVKAARPLEAVSAAVSAPGMRLAQIAATVMAGYADRPAAGQRAFELNTDDATGRTSLRLLPRFETITYRELWQRVGEVAAAWHHDPENPLRAGDFVALLGFTSIDYATLDLADIHLGAVTVPLQASAAVSQLIAILTETSPRLLASTPEHLDAAVECLLAGTTPERLVVFDYHPEDDDQRAAFESARRRLADAGSLVIVETLDAVRARGRDLPAAPLFVPDTDDDPLALLIYTSGSTGTPKGAMYTNRLAATMWQGNSMLQGNSQRVGINLNYMPMSHIAGRISLFGVLARGGTAYFAAKSDMSTLFEDIGLVRPTEIFFVPRVCDMVFQRYQSELDRRSVAGADLDTLDREVKADLRQNYLGGRFLVAVVGSAPLAAEMKTFMESVLDLPLHDGYGSTEAGASVLLDNQIQRPPVLDYKLVDVPELGYFRTDRPHPRGELLLKAETTIPGYYKRPEVTAEIFDEDGFYKTGDIVAELEHDRLVYVDRRNNVLKLSQGEFVTVAHLEAVFASSPLIRQIFIYGSSERSYLLAVIVPTDDALRGRDTATLKSALAESIQRIAKDANLQPYEIPRDFLIETEPFTIANGLLSGIAKLLRPNLKERYGAQLEQMYTDLATGQADELLALRREAADLPVLETVSRAAKAMLGVASADMRPDAHFTDLGGDSLSALSFSNLLHEIFGVEVPVGVVVSPANELRDLANYIEAERNSGAKRPTFTSVHGGGSEIRAADLTLDKFIDARTLAAADSIPHAPVPAQTVLLTGANGYLGRFLCLEWLERLDKTGGTLICVVRGSDAAAARKRLDSAFDSGDPGLLEHYQQLAARTLEVLAGDIGDPNLGLDDATWQRLAETVDLIVHPAALVNHVLPYTQLFGPNVVGTAEIVRLAITARRKPVTYLSTVGVADQVDPAEYQEDSDVREMSAVRVVRESYANGYGNSKWAGEVLLREAHDLCGLPVAVFRSDMILAHSRYAGQLNVQDVFTRLILSLVATGIAPYSFYRTDADGNRQRAHYDGLPADFTAAAITALGIQATEGFRTYDVLNPYDDGISLDEFVDWLVESGHPIQRITDYSDWFHRFETAIRALPEKQRQASVLPLLDAYRNPCPAVRGAILPAKEFQAAVQTAKIGPEQDIPHLSAPLIDKYVSDLELLQLL

SEQ ID NO: 17 - DNA, 3507 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 18 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 19 - DNA, 3507 bp, Mycobacterium smegmatis
ttacagcaatccgagcatctgcaggttgctgatgtacttgacgatcacgtcggccgtgacgtgcggaatgtccttgtcggggccgatcttcgcgtcctgcaccgcggcacggaaccggtcggtgggtgccatggcaccgcacacgggcggtgagggctgctgatagttgtgcagcagcggcagcagcgaggcctgacgttgccgttccggcagggcccgcagtgcggtttcgaaccggctcagccaggtggcgtagtcgtcgacgcggtgcacggggtagccggcctcgatcagccagtccacgtactcgtcgaggccgatgccgtcgtcgtacgggttcatcacgtggaacgtctcgaatccgtcggtgacctgcgagccgatggtggagatcgcctcggcgatgaactccacgggcagcccgtcgtagtgggcgcgctgccggttgccgtccgcatcgagttcgtagaacgaaccgggcgcgatgccggtcgccacgaggctcagcatcaggcgggtgaacatgtccggcaggttcagctgacccgagtaggtcgtgtcggccaggatcatgtcgcagcggaacaccgagaccggcagaccacaccagtcgtgcgcctcccgcagcaggacctcgccggcccacttgctgttgccgtagccgttggcgtacgagtcgtcgacccggcgcgtcgcgctgatctcgcggatgtcggcgtcctcgacgaacgcctcgggggagatgccctgtcccacaccgatcgtcgagacgtacacgtacggcttgatcgtggtggtcagcgcgatccggatgagttcggcggtgccgagcgcattgggtccgaacatctggctgtacggcaggacgtgattgaccagggcggccggatcgacgatcagatcgacggtgtcggccagtcgctgccacgtgtcgtggtcgagacccagatcggcctcgcccttgtcaccggcgatcacctcgaggtgatcggctgccagcgcgcggtagtgctcgagcagtgtcgcgtccccggtgtcgaacgtggcgtccagacgcgcccgggcctcgtcgtcgctgcgggcgcgcaccaggcagatcaccttgccgtccaccaggtccatgcgctccagccattccagcgccagatagcggcccaggaacccggtggcgccggtcagcagcacggtgcggatctcggtgcccgaacgcggcagacccggcgcggcggacagggtcttggcgtcgatgaacttgcccagggcgagatcacgcgcgcgcacctcggtggcgtcgcgcccgtgcaccgacgcgtatgtggggcgcttggagccgcgcagttcgccctcgatgtaggccgcgacgcctgccaggtcggtggccgggctgacgatgacgccgaccggcacgtcgacatcgaagatctcgtgcaacaggttcgagaagctcaaggccgacaacgaatctccacccagatcggtgaagtgcgcatcggaccgcagatccgtgacggaggcaccgagcagtgcgaccgcggcgcggctgacggtctcgaccacgggccggtcggctccgttgcggcgcaactcgcgcaactcgttggcctgcccctcggccaggtcggtgtagagctgttcgaggcgttcgccgtagtgcgccttcagtttcggccgggccagcttgcggataccggtcagcaggccgttctccagcgtgaaaggtgttgtctcgacgaggaagtcacgcgggatctcatacgactgcaatccggcggctcgtgccgcgtcctgcagtgagtcgctgatgcgcgacttgagttcgtcaccgtcccaacgtgacagtgcctcttcggtcgggaccacgaccgccagcagataggaccgcgcgctgttgccgtagacgtagatctggcgtaccagggggctgtcgccgaacaccgcctccagcttggagaccgtgacgaattcgccctgcgacagtttcagcacgttgttgcggcggtcgaggtattcgagatggtcgggcccgagctcggcgacgatgtcgccggtgcggtagtacccgtcctcgtcgaacatctcggcggtgatctccggacgcttgtagtagccggggaacatctgctcggacttgaccagaagttcgccgcgcgggtagggccggtccgtggcgaagtagccgagatcgggcacgtcgaccagcttgtagtcgatgaccggcgggcgctggatctgcccgtcgatgaacaccgcgccggcctcggtggagccgtagccctccagcagatgcatgtcgagcaggtcctcgacccagctcttcatctccgccgagatgggagccgatccggtcagggccgaaacgaatcgcccgccgagcagttgggtgcggacctcttcgaggactgcggcttcggctcggtcctcggatccctcggcgcggcggttgtcgaggcggctctggtactcctggaacagcatgtcccagatgcgaggaacgaagttgagctgcgtgggccgcacgagggcgaggtcctccaggaaggtggacaggtcgctgcgtgcggcgaagtacgcggttccgccgctggcgagtgtgctgcacaggatgccgcgccccatgacgtgactcatgggcatgaagttcagggtgatcgacggcatcacgccgagggtctcgtcccaccgggccttggacccggcctgccacatcgtggcggtcttggactcggggtacatcgcgcccttgggagtgccggtgctgccggaggtgtagatgagaagggtcagcgggtcggcctcgtcgggcacgtagagcggtgcgtcggcgagtgaccgcccgcggtccagtgcgtcggtgatcgtctcgacgacgacgccggtgcctgcgagcttgcccttggccgcctcgaacgcctcacgctgatcgtcgacctcgtggctgtagtcgaacaccaccagtcgcgacggcgcgggcccggactcgacgagagcgactgcgtcggcgaggaagtcgacgctcgacgcgatcaccttgggctcggtctcggcgacgatcggctgcagttgggccaccggcgcactggtctgcagcggtacggacacggcgccgagttcgagcagggcgatgtcgatcgtcgtgtagtcgacactggtgaaacccaggatggccacgcggtcaccggcattcaccggatggttgtgccaggcattggtcacggcctggatccggcctgcgagctgacggtaggtgatggtgtcgaagcggggcaggagcttcgcggtggtgcggccttcttcgtcggtgacgaactcgacggcgcgcttgcccagcgcagggcggtccgcatagccggccagaatctgtttgaccgcggcaggaaggcgcaactccggatcggcggcagccgcgctgatcgcctcgtcgggacgggcggcggcgaactgcgggtcggtttcgaacaagtggtcaatgcgccggttgaagcggtcttcgcgcgtttcgatcgtcat

SEQ ID NO: 20 - protein, 1168 aa, Mycobacterium smegmatis
MTIETREDRFNRRIDHLFETDPQFAAARPDEAISAAAADPELRLPAAVKQILAGYADRPALGKRAVEFVTDEEGRTTAKLLPRFDTITYRQLAGRIQAVTNAWHNHPVNAGDRVAILGFTSVDYTTIDIALLELGAVSVPLQTSAPVAQLQPIVAETEPKVIASSVDFLADAVALVESGPAPSRLVVFDYSHEVDDQREAFEAAKGKLAGTGVVVETITDALDRGRSLADAPLYVPDEADPLTLLIYTSGSTGTPKGAMYPESKTATMWQAGSKARWDETLGVMPSITLNFMPMSHVMGRGILCSTLASGGTAYFAARSDLSTFLEDLALVRPTQLNFVPRIWDMLFQEYQSRLDNRRAEGSEDRAEAAVLEEVRTQLLGGRFVSALTGSAPISAEMKSWVEDLLDMHLLEGYGSTEAGAVFIDGQIQRPPVIDYKLVDVPDLGYFATDRPYPRGELLVKSEQMFPGYYKRPEITAEMFDEDGYYRTGDIVAELGPDHLEYLDRRNNVLKLSQGEFVTVSKLEAVFGDSPLVRQIYVYGNSARSYLLAVVVPTEEALSRWDGDELKSRISDSLQDAARAAGLQSYEIPRDFLVETTPFTLENGLLTGIRKLARPKLKAHYGERLEQLYTDLAEGQANELRELRRNGADRPVVETVSRAAVALLGASVTDLRSDAHFTDLGGDSLSALSFSNLLHEIFDVDVPVGVIVSPATDLAGVAAYIEGELRGSKRPTYASVHGRDATEVRARDLALGKFIDAKTLSAAPGLPRSGTEIRTVLLTGATGFLGRYLALEWLERMDLVDGKVICLVRARSDDEARARLDATFDTGDATLLEHYRALAADHLEVIAGDKGEADLGLDHDTWQRLADTVDLIVDPAALVNHVLPYSQMFGPNALGTAELIRIALTTTIKPYVYVSTIGVGQGISPEAFVEDADIREISATRRVDDSYANGYGNSKWAGEVLLREAHDWCGLPVSVFRCDMILADTTYSGQLNLPDMFTRLMLSLVATGIAPGSFYELDADGNRQRAHYDGLPVEFIAEAISTIGSQVTDGFETFHVMNPYDDGIGLDEYVDWLIEAGYPVHRVDDYATWLSRFETALRALPERQRQASLLPLLHNYQQPSPPVCGAMAPTDRFRAAVQDAKIGPDKDIPHVTADVIVKYISNLQMLGLL

SEQ ID NO: 21 - DNA, 3522 bp, Mycobacterium smegmatis
atgaccagcgatgttcacgacgccacagacggcgtcaccgaaaccgcactcgacgacgagcagtcgacccgccgcatcgccgagctgtacgccaccgatcccgagttcgccgccgccgcaccgttgcccgccgtggtcgacgcggcgcacaaacccgggctgcggctggcagagatcctgcagaccctgttcaccggctacggtgaccgcccggcgctgggataccgcgcccgtgaactggccaccgacgagggcgggcgcaccgtgacgcgtctgctgccgcggttcgacaccctcacctacgcccaggtgtggtcgcgcgtgcaagcggtcgccgcggccctgcgccacaacttcgcgcagccgatctaccccggcgacgccgtcgcgacgatcggtttcgcgagtcccgattacctgacgctggatctcgtatgcgcctacctgggcctcgtgagtgttccgctgcagcacaacgcaccggtcagccggctcgccccgatcctggccgaggtcgaaccgcggatcctcaccgtgagcgccgaatacctcgacctcgcagtcgaatccgtgcgggacgtcaactcggtgtcgcagctcgtggtgttcgaccatcaccccgaggtcgacgaccaccgcgacgcactggcccgcgcgcgtgaacaactcgccggcaagggcatcgccgtcaccaccctggacgcgatcgccgacgagggcgccgggctgccggccgaaccgatctacaccgccgaccatgatcagcgcctcgcgatgatcctgtacacctcgggttccaccggcgcacccaagggtgcgatgtacaccgaggcgatggtggcgcggctgtggaccatgtcgttcatcacgggtgaccccacgccggtcatcaacgtcaacttcatgccgctcaaccacctgggcgggcgcatccccatttccaccgccgtgcagaacggtggaaccagttacttcgtaccggaatccgacatgtccacgctgttcgaggatctcgcgctggtgcgcccgaccgaactcggcctggttccgcgcgtcgccgacatgctctaccagcaccacctcgccaccgtcgaccgcctggtcacgcagggcgccgacgaactgaccgccgagaagcaggccggtgccgaactgcgtgagcaggtgctcggcggacgcgtgatcaccggattcgtcagcaccgcaccgctggccgcggagatgagggcgttcctcgacatcaccctgggcgcacacatcgtcgacggctacgggctcaccgagaccggcgccgtgacacgcgacggtgtgatcgtgcggccaccggtgatcgactacaagctgatcgacgttcccgaactcggctacttcagcaccgacaagccctacccgcgtggcgaactgctggtcaggtcgcaaacgctgactcccgggtactacaagcgccccgaggtcaccgcgagcgtcttcgaccgggacggctactaccacaccggcgacgtcatggccgagaccgcacccgaccacctggtgtacgtggaccgtcgcaacaacgtcctcaaactcgcgcagggcgagttcgtggcggtcgccaacctggaggcggtgttctccggcgcggcgctggtgcgccagatcttcgtgtacggcaacagcgagcgcagtttccttctggccgtggtggtcccgacgccggaggcgctcgagcagtacgatccggccgcgctcaaggccgcgctggccgactcgctgcagcgcaccgcacgcgacgccgaactgcaatcctacgaggtgccggccgatttcatcgtcgagaccgagccgttcagcgccgccaacgggctgctgtcgggtgtcggaaaactgctgcggcccaacctcaaagaccgctacgggcagcgcctggagcagatgtacgccgatatcgcggccacgcaggccaaccagttgcgcgaactgcggcgcgcggccgccacacaaccggtgatcgacaccctcacccaggccgctgccacgatcctcggcaccgggagcgaggtggcatccgacgcccacttcaccgacctgggcggggattccctgtcggcgctgacactttcgaacctgctgagcgatttcttcggtttcgaagttcccgtcggcaccatcgtgaacccggccaccaacctcgcccaactcgcccagcacatcgaggcgcagcgcaccgcgggtgaccgcaggccgagtttcaccaccgtgcacggcgcggacgccaccgagatccgggcgagtgagctgaccctggacaagttcatcgacgccgaaacgctccgggccgcaccgggtctgcccaaggtcaccaccgagccacggacggtgttgctctcgggcgccaacggctggctgggccggttcctcacgttgcagtggctggaacgcctggcacctgtcggcggcaccctcatcacgatcgtgcggggccgcgacgacgccgcggcccgcgcacggctgacccaggcctacgacaccgatcccgagttgtcccgccgcttcgccgagctggccgaccgccacctgcgggtggtcgccggtgacatcggcgacccgaatctgggcctcacacccgagatctggcaccggctcgccgccgaggtcgacctggtggtgcatccggcagcgctggtcaaccacgtgctcccctaccggcagctgttcggccccaacgtcgtgggcacggccgaggtgatcaagctggccctcaccgaacggatcaagcccgtcacgtacctgtccaccgtgtcggtggccatggggatccccgacttcgaggaggacggcgacatccggaccgtgagcccggtgcgcccgctcgacggcggatacgccaacggctacggcaacagcaagtgggccggcgaggtgctgctgcgggaggcccacgatctgtgcgggctgcccgtggcgacgttccgctcggacatgatcctggcgcatccgcgctaccgcggtcaggtcaacgtgccagacatgttcacgcgactcctgttgagcctcttgatcaccggcgtcgcgccgcggtcgttctacatcggagacggtgagcgcccgcgggcgcactaccccggcctgacggtcgatttcgtggccgaggcggtcacgacgctcggcgcgcagcagcgcgagggatacgtgtcctacgacgtgatgaacccgcacgacgacgggatctccctggatgtgttcgtggactggctgatccgggcgggccatccgatcgaccgggtcgacgactacgacgactgggtgcgtcggttcgagaccgcgttgaccgcgcttcccgagaagcgccgcgcacagaccgtactgccgctgctgcacgcgttccgcgctccgcaggcaccgttgcgcggcgcacccgaacccacggaggtgttccacgccgcggtgcgcaccgcgaaggtgggcccgggagacatcccgcacctcgacgaggcgctgatcgacaagtacatacgcgatctgcgtgagttcggtctgatctga

SEQ ID NO: 22 - protein, 1173 aa, Mycobacterium smegmatis
MTSDVHDATDGVTETALDDEQSTRRIAELYATDPEFAAAAPLPAVVDAAHKPGLRLAEILQTLFTGYGDRPALGYRARELATDEGGRTVTRLLPRFDTLTYAQVWSRVQAVAAALRHNFAQPIYPGDAVATIGFASPDYLTLDLVCAYLGLVSVPLQHNAPVSRLAPILAEVEPRILTVSAEYLDLAVESVRDVNSVSQLVVFDHHPEVDDHRDALARAREQLAGKGIAVTTLDAIADEGAGLPAEPIYTADHDQRLAMILYTSGSTGAPKGAMYTEAMVARLWTMSFITGDPTPVINVNFMPLNHLGGRIPISTAVQNGGTSYFVPESDMSTLFEDLALVRPTELGLVPRVADMLYQHHLATVDRLVTQGADELTAEKQAGAELREQVLGGRVITGFVSTAPLAAEMRAFLDITLGAHIVDGYGLTETGAVTRDGVIVRPPVIDYKLIDVPELGYFSTDKPYPRGELLVRSQTLTPGYYKRPEVTASVFDRDGYYHTGDVMAETAPDHLVYVDRRNNVLKLAQGEFVAVANLEAVFSGAALVRQIFVYGNSERSFLLAVVVPTPEALEQYDPAALKAALADSLQRTARDAELQSYEVPADFIVETEPFSAANGLLSGVGKLLRPNLKDRYGQRLEQMYADIAATQANQLRELRRAAATQPVIDTLTQAAATILGTGSEVASDAHFTDLGGDSLSALTLSNLLSDFFGFEVPVGTIVNPATNLAQLAQHIEAQRTAGDRRPSFTTVHGADATEIRASELTLDKFIDAETLRAAPGLPKVTTEPRTVLLSGANGWLGRFLTLQWLERLAPVGGTLITIVRGRDDAAARARLTQAYDTDPELSRRFAELADRHLRVVAGDIGDPNLGLTPEIWHRLAAEVDLVVHPAALVNHVLPYRQLFGPNVVGTAEVIKLALTERIKPVTYLSTVSVAMGIPDFEEDGDIRTVSPVRPLDGGYANGYGNSKWAGEVLLREAHDLCGLPVATFRSDMILAHPRYRGQVNVPDMFTRLLLSLLITGVAPRSFYIGDGERPRAHYPGLTVDFVAEAVTTLGAQQREGYVSYDVMNPHDDGISLDVFVDWLIRAGHPIDRVDDYDDWVRRFETALTALPEKRRAQTVLPLLHAFRAPQAPLRGAPEPTEVFHAAVRTAKVGPGDIPHLDEALIDKYIRDLREFGLI

SEQ ID NO: 23 - DNA, 3525 bp, Mycobacterium ulcerans
atgtcgccaatcacgcgtgaagagcggctcgagcgccgcatccaggacctctacgccaacgacccgcagttcgccgccgccaaacccgtcacggcgatcaccgcagcaatcgagcggccgggtctaccgctaccccagatcatcgagaccgtcatgaccggatacgccgatcggccggctctcgctcagcgctcggtcgaattcgtgaccgatgccggcaccggccacaccacgctgcgactgctcccccacttcgaaaccatcagctacggcgagctttgggaccgcatcagcgcactggccgacgtgctcagcaccgaacagacggtgaaaccgagcgaccgggtctgcttgttgggcttcaacagcgtcgactacgccacgatcgacatgactttggcgcggctgggcgcggtggctgtaccactgcagaccagcgcggcgataacccagctgcagccgatcgtcgccgagacccagcccaccatgatcgcggccagcgtcgacgcactcgctgacgccaccgaattggctctgtccggtcagaccgctacccgagtcctggtgttcgaccaccaccggcaggttgacgcacaccgcgcagcggtcgaatccgcccgggagcgcctggctggctcggcggtcgtcgaaaccctggccgaggccatcgcgcgcggcgacgtgccccgcggtgcgtccgccggctcggcgcccggcaccgatgtgtccgacgactcgctcgcgctactgatctacacctcgggcagcaccggtgcgcccaagggcgcgatgtacccccgacgcaacgttgcgaccttctggcgcaagcgcacctggttcgaaggcggctacgagccgtcgatcacgctgaacttcatgccaatgagccacgtcatgggccgccaaatcctgtacggcacgctgtgcaatggcggcaccgcctacttcgtggtgaaaagcgatctctccaccttgttcgaagacctggcgctggtgcggcccaccgagctgaccttcgtgccgcgcgtgtgggacatggtgttcgacgagtttcagagtgaggtcgaccgccgcctggtcgacggcgccgaccgggtcgcgctcgaagcccaggtcaaggccgagatacgcaacgacgtgctcggtggacggtataccagcgcactgaccggctccgccccgatctccgacgagatgaaggcgtgggtcgaggagctgctcgacatgcatctggtcgagggctacggctccaccgaggccgggatgatcctgatcgacggagccattcggcgcccggcggtactcgactacaagctggtcgatgttcccgacctgggttacttcctgaccgaccggccacatccgcggggcgagttgctggtcaagaccgatagtttgttcccgggctactaccagcgagccgaagtcaccgccgacgtgttcgatgctgacggcttctaccggaccggcgacatcatggccgaggtcggccccgaacagttcgtgtacctcgaccgccgcaacaacgtgttgaagctgtcgcagggcgagttcgtcaccgtctccaaactcgaagcggtgtttggcgacagcccactggtacggcagatctacatctacggcaacagcgcccgtgcctacctgttggcggtgatcgtccccacccaggaggcgctggacgccgtgcctgtcgaggagctcaaggcgcggctgggcgactcgctgcaagaggtcgcaaaggccgccggcctgcagtcctacgagatcccgcgcgacttcatcatcgaaacaacaccatggacgctgcagaacggcctgctcaccggcatccgcaagttggccaggccgcagctgaaaaagcattacggcgagcttctcgagcagatctacacggacctggcacacggccaggccgacgaactgcgctcgctgcgccaaagcggtgccgatgcgccggtgctggtgacggtgtgccgcgcggcggccgcgctgttgggcggcagcgcctctgacgtccagcccgatgcgcacttcaccgatttgggcggcgactcgctgtcggcgctgtcgttcaccaacctgctgcacgagatcttcgacatcgatgtgccggtgggcgtcatcgtcagccccgccaacgacttgcaggccctggccgactacgtcgaggcggctcgcaaacccggctcgtcacgaccgaccttcgcctcggtccacggcgcctcgaatgagcaggtcaccgaggtgcatgccggtgacctgtccctggacaaattcatcgatgccgcaaccctggccgaagctccccggctgcccgccgcaaacacccaagtgcgcaccgtgctgctgaccggcgccaccggcttcctcgggcgctacctggccctggaatggctggagcggatggacctggtcgacggcaaactgatctgcctggtccgggccaagtccgacaccgaagcacgggcgcggctggaaaagacgttcgacagcggcgcccccgaactgctggcccactaccgcgcactggccggcgaccacctcgaggtgctcgccggtgacaagggcgaagccgacctcggactggaccggcagacctggcaacgcctggccgacacggtcgacctgatcgtggaccccgcggccctggtcaaccacgtactgccatacagccagctgttcgggcccaacgcgctgggcaccgccgagctgctgcggctcgcgctcacctccaagatcaagccctacagctacacctcgacaatcggtgtcgccgaccagatcccgccgtcggcgttcaccgaggacgccgacatccgggtcatcagcgccacccgcgcggtcgacgacagctacgccaatggctattcgaacagcaagtgggccggcgaggtgctgttgcgcgaggcgcatgtcctgtgtggcctgccggttgcggtgttccgctgcgacatgatcctggccgacaccacatgggcgggacagctcaacgtgccggacatgttcacccgtatgatcctgagcctggcggccaccggtatcgcgccgggttcgttctatgagcttgcggccgacggcgcccggcaacgcgcccactatgacggtctgcccgtcgagttcatcgccgaggcgatttcgactttgggtgcgcagagccaggatgggttccacacgtatcacgtgatgaacccttacgacgacggcatcggactcgacgagttcgtcgactggctcaacgagtccggttgccccatccagcgcatcgctgactatggcgactggctgcagcgcttcgaaaccgcactgcgcgcactgcccgatcggcagcggcacagctcactgctgccgctgttgcacaactatcggcagccggagcggcccgtccgcgggtcgatcgcccctaccgatcgcttccgggcagcggtgcaagaggccaagatcggccccgacaaagacattccgcacgtcggcgcgccgatcatcgtgaagtacgtcagcgacctgcgcctactcggcctgctctga

SEQ ID NO: 24 - protein, 1174 aa, Mycobacterium ulcerans
MSPITREERLERRIQDLYANDPQFAAAKPVTAITAAIERPGLPLPQIIETVMTGYADRPALAQRSVEFVTDAGTGHTTLRLLPHFETISYGELWDRISALADVLSTEQTVKPSDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVVKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLQNGLLTGIRKLARPQLKKHYGELLEQIYTDLAHGQADELRSLRQSGADAPVLVTVCRAAAALLGGSASDVQPDAHFTDLGGDSLSALSFTNLLHEIFDIDVPVGVIVSPANDLQALADYVEAARKPGSSRPTFASVHGASNEQVTEVHAGDLSLDKFIDAATLAEAPRLPAANTQVRTVLLTGATGFLGRYLALEWLERMDLVDGKLICLVRAKSDTEARARLEKTFDSGAPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHVLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 25 - DNA, 3318 bp, Tsukamurella paurometabola
atgtcgattgagacggtgcagaacggcgtccccgcagagggctcggtgccccccgccgaccagcagaccgagcgactgccgcaggtgatcgccaggatcttcgcccagttcgcggatcgtccggccttcgcgacccgcgaggcggggccggggaccccctacgccaccgtctcctatcgggagatctggcggcgcgtcaccgcgctggtggcctcctggcagagcgaagtggctccgggagacttcgtcgccatcctcggcttcaccagctcggacttcgtgaccgtcgacctcgcgaccacactgctcggcgccccgaacgtgccgctccaggccggggcccccgccgctcgcatcgcgaccatcctcgatgagacccggccgaagatcctcgccgtgagtgccgatcaggtcgacctcgcccaggaggctctggccgagtccgcggctaccccgcgggtggtcgtcttcgacggcgaacgcgacggctacgagggcatcgaggcggacatcctttccggctccgccctgccggcaccggagttcttcgcgcccgagcccggcaccgatcctctcgtcacgctcatctacacatccggcagcaccggtaccccgaagggggccatgtacaccgagcagttggttcgcgatgcctggctcaaggtggacagcatcgtcgacatcgacatgccggccgagtcgctcctgcacttcctgcctatgagccatatgtacgggcgcaactggctgatcgccggcctggcatcgggcgggaccgggtacttcgccggcgcctccgatatgtccaccctgttcgacgacctcgccgccgcccggcccaccgccatcggcctggtgccccgcgtgtgcgagctgatacaccagcgctatctggccgtcgaggcggacactgatgcggagaccgcgcgcgtcgaactgcgtgaccgggtactcggcggtcggctgcaggccgcgatgtgcggtagcgccgccctctcgtcggagctgcagaccttcatggagtggttgctcggaatcgatatccagatcggctacggatccaccgaggccggtggtgtcatccgcgacggagtggtcgttcggccgccggtcacggagtacaagctgatcgatgtccccgaactgggctacttcgtcaccgactccccgcatccacgcggcgaactcctggtcaagtcgacgcagttgattcccgggtactacaactccgacaagcggatccgcgacgacgaaggcttctaccgcaccggcgatgtgatggccgagctgggacccgaccggctcgagtacgtcgaccggcggagcaacgtgatcaagttggcacagggagagttcgtgccgatcgcccaactcgaggccatctacgccgccggtcccgatgtgcaccagatcttcctgtacggaaccagcgaacgctcctacctgatcggcgtcgtcgtgcccgcgccgggacccgacggcgagaccgatgcgcagacccgcacccgcgtactcgatggcctggccgcgatcgcccgtgagaacgatctcgctgcctacgaggtgccgcgcgatgtgctcatcgaacgtgatcccttctctcaggagaacgggctgcggtcggggatcggcaagctggtgcgcccggccctcatcgcccgctacggtgaccggttgcacgacctctacgcccaggccgacacccgtcaacgcgagggcttgcgcgctctcgacgcctcgggcccgatcatcgacaccgtgctcggggcggctgcgttgacgctcggcgcggatatcgcggacttcgacgccgacactcgattcggcgacctcggtggcgactcgttgtcggcgctctcgctcgcgacgacgctcgaaggcctctacgacgtgcccgtccccgtgcagacgatcgtcggaccgaccgccacactcggcggcgtcgcccggcacatcgagaaggctcgatcgggtggcgtcgcggcaccgaccgccgactcggtgcacggcgtgggtgcgagcgtcgcccgggccaccgacctgacgctggagaagttcatcgaccccgagctcctcgcgctcgcgccgacgcttcccgcggcgaccggtgagccgaacaccgtgctgctcaccggatccaccggctacctcggccgcttcctgctgctggactggttgcgacgggtcgctccgcacggcggcaccgtgatcgcgctggtgcgcggcgccgacgccgacgatgcgcgacgccgcgtcacggccgcgatcggtgactcggatcctgacctgacacaagagttcacgtcactcgcggagcatcacctccacgtgatcgccggtgacttcggcagccccgcactcggactcgacgatgccacctggagcgatctcgccgggcgagtcgatcacgtggtgcactgcggcgcgctcgtcaaccacgtgctgccctacgaccaactgttcggtcccaatgtggtggccaccggcgaagtggtgcgactcgcactcaccacgcgccgcaagtccgtggattacgtctccacggtggctgtggttccgcaggatgacggccgcgtcctggtcgaggacgacgatgttcgcgagctcggcgccgaacggcgcatcggggccgatgcctacgcgaacggctacgccgtgagcaaatgggcgggcgaagtgctgttgcatgaggcagccgacctggcggacctgccggtgcgggtgttccgctccgatatgatcttggcgcacagtcgattccacggacagttcaacgaggtcgaccagttcacccgcctgctcctgagtatcgccgagaccggactggcgccggcgtcgttctacacgccggatccgagtggacaccgcccgcactacgacgggctgccggtggacttcaccgccgaagcgatcaccacgctcagcgccgcggggcgttcggggtaccggaccttccacgtgctcaacgccaacgatgacggcgtgagcctggacagcttcgtcgactggatcgccgcctcgggccggagcatcgaacggatcgacgactacgacacctggttcgcccggttcgagcaggcgctccagcagctccccgatgaggcgcgccagcggtcggtgctgcccctgctgcacgcggtgcgcgagccggctccggccgccgggacctccgcgctgtcggtggaccggttccgtggtgcggtgcgtgagaccggagtaggaccgggggacatcccggtgctcgatcgcgccctgatcgagaagtacctgcgcgacttcgagaccgcgggctggctcgcgcccggtgcgcgcgactga

SEQ ID NO: 26 - protein, 1105 aa, Tsukamurella paurometabola
MSIETVQNGVPAEGSVPPADQQTERLPQVIARIFAQFADRPAFATREAGPGTPYATVSYREIWRRVTALVASWQSEVAPGDFVAILGFTSSDFVTVDLATTLLGAPNVPLQAGAPAARIATILDETRPKILAVSADQVDLAQEALAESAATPRVVVFDGERDGYEGIEADILSGSALPAPEFFAPEPGTDPLVTLIYTSGSTGTPKGAMYTEQLVRDAWLKVDSIVDIDMPAESLLHFLPMSHMYGRNWLIAGLASGGTGYFAGASDMSTLFDDLAAARPTAIGLVPRVCELIHQRYLAVEADTDAETARVELRDRVLGGRLQAAMCGSAALSSELQTFMEWLLGIDIQIGYGSTEAGGVIRDGVVVRPPVTEYKLIDVPELGYFVTDSPHPRGELLVKSTQLIPGYYNSDKRIRDDEGFYRTGDVMAELGPDRLEYVDRRSNVIKLAQGEFVPIAQLEAIYAAGPDVHQIFLYGTSERSYLIGVVVPAPGPDGETDAQTRTRVLDGLAAIARENDLAAYEVPRDVLIERDPFSQENGLRSGIGKLVRPALIARYGDRLHDLYAQADTRQREGLRALDASGPIIDTVLGAAALTLGADIADFDADTRFGDLGGDSLSALSLATTLEGLYDVPVPVQTIVGPTATLGGVARHIEKARSGGVAAPTADSVHGVGASVARATDLTLEKFIDPELLALAPTLPAATGEPNTVLLTGSTGYLGRFLLLDWLRRVAPHGGTVIALVRGADADDARRRVTAAIGDSDPDLTQEFTSLAEHHLHVIAGDFGSPALGLDDATWSDLAGRVDHVVHCGALVNHVLPYDQLFGPNVVATGEVVRLALTTRRKSVDYVSTVAVVPQDDGRVLVEDDDVRELGAERRIGADAYANGYAVSKWAGEVLLHEAADLADLPVRVFRSDMILAHSRFHGQFNEVDQFTRLLLSIAETGLAPASFYTPDPSGHRPHYDGLPVDFTAEAITTLSAAGRSGYRTFHVLNANDDGVSLDSFVDWIAASGRSIERIDDYDTWFARFEQALQQLPDEARQRSVLPLLHAVREPAPAAGTSALSVDRFRGAVRETGVGPGDIPVLDRALIEKYLRDFETAGWLAPGARD

SEQ ID NO: 27 - DNA, 3435 bp, Cyanobium sp.
gtgaatgagtcttccgcggaccagagttccggcaacgtttccgaggggtggcctgatgcttcggtcacagcacgggccctgcaggctcacctgcgctacgaacagatcatcgatgccattctgagcggctacgccgagcgccctgctctggcggagcgttcctacctggtgcggccggacccgagcacaggtcaaacggtgcgtgtccacgagcaggccttccgctcgatcagctaccgaaccctgcaggaacgggttcatgccctcaccatggcctggcgccttcatcccgatagcccggtgcaagcgggagccttcgtggtgctggtgggatttgccagcatcgattacgccgttcttgatctggcactggcctacaccaagggcgtgccggtgcccctgtcaccgaaccattccagcgaggacgatgacgccatcctcggcacagtccagcccgtcactctggcggtatcgatcagtgagttctctggctgtgtcgacctgatcgcccgatcgacgtcgatccgaactgtgatcgtctttgaccttgaccctgccgtcgactgcgagcgcgccgcactggagagcggcatccgggcactcaacgagaaggggtcagacgttgtcgttcagacactgcaggatctgattgacgttgggagagacgcagagttcagcttcctgccgatccaggcgcaggatcaagatgacctggcacttctgattcacacatccggcagcacaggcacacccaagggagcctgcatctcatcccgtgcactgatcaacacctggcgccatgtttccggtccctatccaaaagtgaccgtggttctggcacccttccaccacatgatgggacgagactcgatgatcacggcattgggcgcgggcggcaccgcctacttcacgctcaggcctgacctttcgaccgtgattgaagacatcagactggcacggcccacaggcctggtgctgtttccccgcctctgcgaagtgatcgaacaccacctgactactgcgccggagtattcaggcaacgagatcctcggaggcagactgcaatccattgtggtggcctcggctccgatcacgccacgcttgaaggcatccctggagtgcctccttggggtgcctgtgagcgaaggctacagcagcacggaaacagccagtggcgggctggcgatgaatggactgctgaaccgcaacaacattctcgcgtatcgccttcgcgatgtgcccgaggcagggtattcagtgaatgatcggccctttccgcgcggagaactctgcgtgaagacccgcttcggtatctcaggctatttcagaaatccagaggccactgcagagctgttcgacgacgatggcttctattgcaccggtgacatcgttgaagagcgggcccccgatcaaatcgccatcatcgaccggcgaaagaatgtcatcaagctggcgcagggtgaatatgtcgctgtgggcaggctggaacagcttttccaggaaggttgtggttgcgtgcagcagattcacctccacggcgacagcacaagggcctatctgctggcagtcgtggtacctgatcgcaacacccttgcaccgcccgggtcacggcaggccagtgaggccgagttaaaggcacgggtgcgcgaggagattctcaccttggcaaaccaacgggagctgcgcggcttcgagatccctcgagacctgatcctggcggaggaacccttctcccagcagaacggtctgctgtcgtccttgggtaagccgatccgcccggccatccgcgcgcgctaccgcagccggctggagagcctgtatgccagccatgaggccacccgaggcactgagctcgaggccatcagagcgtcagctggcgcggtggatgtggaaaccaccctgttggcgctgctgagcagcacgctgggtgtggtgtgtggggctgccgatcggcagacgagtttccgcgagctggggggcgactccctggccgctgtgcagctggcgatggagatcaagaagcagttcggggtggggctggaagggagccagattctcgggccgggcggcacggtggaagcgtgggcgcggaggatccacaccgcctccatccagcaggccccgcaccagcgggttggcagtcccctcgccgccattccggccgaggggtggctgaagccggaccactacaggctggagaacctgatcgggattcccatcggtacaccctcagccgaggtggccaggcccacaggcgggccccctacggttctgctcaccggtgccaccggttttctgggggggcgcttgtgcctggagtggctgcaacggctggctggccaggggggcaggctgatctgtctggtgcgcccctcgaacagccattccgcctgggagcgactgaggaaccgcttctcccatctggaacccgagcaggtggcacgcttccgcgagctggcgggaaggcatctggaggtgattccggcggacatcggagagcccggcctggggcttgaaccgggttgccaggagcggctcgccactgaggtggacgcgatctgtcactgcgcagcggaagtgaatcaccggctgccctatcgccacctctaccggcccaatgtgatcggcaccgcggagatcattcacctggcgatcacgacgcggctgaaatcggtggacttcatctccagcatcggggtggcttccctgccccggcggccgggagggagcatcccggtggagggcggctacgcccggggctacttcgccagcaagtgggcttgcgagcaactgctgcgctccacccatgactgcaccggtgtgcccgtacgggtgattcggcccagcctcattcttcccgatcgtgtgctggccggggagatgaacccggacgatctgctttcaagactgctgtacagcatcctggtgaccgggatcgcccccgggtgctttggggaggagtcgcagaacagtggacgatcggggttctcggtgcagggcctccccgtcgaccagttggcgcagaccatccttgccctcggggaagcgcgcacggagggatttcatgtgctcaacctcaacgctgacagtggcagcggtgttcccctggatgccatcctccaggacatcgccgccaaaggaatcaggctgcgacgggtggagggctatgacctctggctcgacgcgatcacaacccgcctgcgtcgcctgccagccgagcaacgggcccgttccctgctggatgtggcggaagcctatgcaggatcagcaggccagacaacgcagagcagcggtgaaatgcaggcgggcagcagctcctgcccggaggagatcaccagcctgcaaccggacttcagtagggcctacaggcgcaagatcgtggatgatctggctcggtgggggctgatcgagcctccaggacccgtggatcagtga

SEQ ID NO: 28 - protein, 1144 aa, Cyanobium sp.
MNESSADQSSGNVSEGWPDASVTARALQAHLRYEQIIDAILSGYAERPALAERSYLVRPDPSTGQTVRVHEQAFRSISYRTLQERVHALTMAWRLHPDSPVQAGAFVVLVGFASIDYAVLDLALAYTKGVPVPLSPNHSSEDDDAILGTVQPVTLAVSISEFSGCVDLIARSTSIRTVIVFDLDPAVDCERAALESGIRALNEKGSDVVVQTLQDLIDVGRDAEFSFLPIQAQDQDDLALLIHTSGSTGTPKGACISSRALINTWRHVSGPYPKVTVVLAPFHHMMGRDSMITALGAGGTAYFTLRPDLSTVIEDIRLARPTGLVLFPRLCEVIEHHLTTAPEYSGNEILGGRLQSIVVASAPITPRLKASLECLLGVPVSEGYSSTETASGGLAMNGLLNRNNILAYRLRDVPEAGYSVNDRPFPRGELCVKTRFGISGYFRNPEATAELFDDDGFYCTGDIVEERAPDQIAIIDRRKNVIKLAQGEYVAVGRLEQLFQEGCGCVQQIHLHGDSTRAYLLAVVVPDRNTLAPPGSRQASEAELKARVREEILTLANQRELRGFEIPRDLILAEEPFSQQNGLLSSLGKPIRPAIRARYRSRLESLYASHEATRGTELEAIRASAGAVDVETTLLALLSSTLGVVCGAADRQTSFRELGGDSLAAVQLAMEIKKQFGVGLEGSQILGPGGTVEAWARRIHTASIQQAPHQRVGSPLAAIPAEGWLKPDHYRLENLIGIPIGTPSAEVARPTGGPPTVLLTGATGFLGGRLCLEWLQRLAGQGGRLICLVRPSNSHSAWERLRNRFSHLEPEQVARFRELAGRHLEVIPADIGEPGLGLEPGCQERLATEVDAICHCAAEVNHRLPYRHLYRPNVIGTAEIIHLAITTRLKSVDFISSIGVASLPRRPGGSIPVEGGYARGYFASKWACEQLLRSTHDCTGVPVRVIRPSLILPDRVLAGEMNPDDLLSRLLYSILVTGIAPGCFGEESQNSGRSGFSVQGLPVDQLAQTILALGEARTEGFHVLNLNADSGSGVPLDAILQDIAAKGIRLRRVEGYDLWLDAITTRLRRLPAEQRARSLLDVAEAYAGSAGQTTQSSGEMQAGSSSCPEEITSLQPDFSRAYRRKIVDDLARWGLIEPPGPVDQ

SEQ ID NO: 29 - DNA, 3522 bp, Mycobacterium avium
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccattacgtacggcgaagtggcgcagcgtgtttcggcgctgggccgcgccctgtctgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccggcaccggcgtggccgtccagacgctggccgagctgctggagcgcggcaaggacctgcccgccgtcgcggagccgcccgccgacgaggactcgctggccctgctgatctacacctccgggtccaccggcgcccccaagggcgcgatgtacccgcagagcaacgtcggcaagatgtggcgccgcggcagcaagaactggttcggcgagagcgccgcgtcgatcaccctgaatttcatgccgatgagccacgtgatgggccgaagcatcctctacggcacgctgggcaacggcggcaccgcctacttcgccgcccgcagcgacctgtccaccctgctcgaggacctcgagctggtgcggcccaccgagctcaacttcgtcccgcggatctgggagacgctgtacggcgaattccagcgtcaggtcgagcggcggctctccgaggccggggacgccggcgaacgtcgcgccgtcgaggccgaggtgctggccgagcagcgccagtacctgctgggcgggcggttcaccttcgcgatgacgggctcggcgcccatctcgcccgagctgcgcaactgggtcgagtcgctgctcgaaatgcacctgatggacggctacggctccacggaggccggaatggtgttgttcgacggggagattcagcgcccgccggtggtcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccgacgagctggccgagctgcgccgcaacggtgcccaggcgccggtgttgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtgggcgtgatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgacacgctggcctccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaagctgctcgcgcactaccagcagctggctgccgatcacctggaggtcatcgccggcgacaagggcgaggccaatctgggcctgcgccaagatgtttggcaacggctggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctacggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcatcggtctggacgagtacgtcgattggctggtggacgccggctattcgatcgagcggatcgccgactactccgaatggctgcggcggttcgagacctcgctgcgggccctgccggaccggcagcgccagtactcgctgctgccgctgctgcacaactaccgcacgcccgagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctga

SEQ ID NO: 30 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYGEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSGTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVVDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQADELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDADTLASAPNLPKPATEVRTVLLTGATGFLGRYLALEWLERMDMVDGKVIALVRARSDEEARARLDKTFDSGDPKLLAHYQQLAADHLEVIAGDKGEANLGLRQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGIGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 31 - DNA, 3507 bp, Mycobacterium smegmatis
atgacgatcgaaacgcgcgaagaccgcttcaaccggcgcattgaccacttgttcgaaaccgacccgcagttcgccgccgcccgtcccgacgaggcgatcagcgcggctgccgccgatccggagttgcgccttcctgccgcggtcaaacagattctggccggctatgcggaccgccctgcgctgggcaagcgcgccgtcgagttcgtcaccgacgaagaaggccgcaccaccgcgaagctcctgccccgcttcgacaccatcacctaccgtcagctcgcaggccggatccaggccgtgaccaatgcctggcacaaccatccggtgaatgccggtgaccgcgtggccatcctgggtttcaccagtgtcgactacacgacgatcgacatcgccctgctcgaactcggcgccgtgtccgtaccgctgcagaccagtgcgccggtggcccaactgcagccgatcgtcgccgagaccgagcccaaggtgatcgcgtcgagcgtcgacttcctcgccgacgcagtcgctctcgtcgagtccgggcccgcgccgtcgcgactggtggtgttcgactacagccacgaggtcgacgatcagcgtgaggcgttcgaggcggccaagggcaagctcgcaggcaccggcgtcgtcgtcgagacgatcaccgacgcactggaccgcgggcggtcactcgccgacgcaccgctctacgtgcccgacgaggccgacccgctgacccttctcatctacacctccggcagcaccggcactcccaagggcgcgatgtaccccgagtccaagaccgccacgatgtggcaggccgggtccaaggcccggtgggacgagaccctcggcgtgatgccgtcgatcaccctgaacttcatgcccatgagtcacgtcatggggcgcggcatcctgtgcagcacactcgccagcggcggaaccgcgtacttcgccgcacgcagcgacctgtccaccttcctggaggacctcgccctcgtgcggcccacgcagctcaacttcgttcctcgcatctgggacatgctgttccaggagtaccagagccgcctcgacaaccgccgcgccgagggatccgaggaccgagccgaagccgcagtcctcgaagaggtccgcacccaactgctcggcgggcgattcgtttcggccctgaccggatcggctcccatctcggcggagatgaagagctgggtcgaggacctgctcgacatgcatctgctggagggctacggctccaccgaggccggcgcggtgttcatcgacgggcagatccagcgcccgccggtcatcgactacaagctggtcgacgtgcccgatctcggctacttcgccacggaccggccctacccgcgcggcgaacttctggtcaagtccgagcagatgttccccggctactacaagcgtccggagatcaccgccgagatgttcgacgaggacgggtactaccgcaccggcgacatcgtcgccgagctcgggcccgaccatctcgaatacctcgaccgccgcaacaacgtgctgaaactgtcgcagggcgaattcgtcacggtctccaagctggaggcggtgttcggcgacagccccctggtacgccagatctacgtctacggcaacagcgcgcggtcctatctgctggcggtcgtggtcccgaccgaagaggcactgtcacgttgggacggtgacgaactcaagtcgcgcatcagcgactcactgcaggacgcggcacgagccgccggattgcagtcgtatgagatcccgcgtgacttcctcgtcgagacaacacctttcacgctggagaacggcctgctgaccggtatccgcaagctggcccggccgaaactgaaggcgcactacggcgaacgcctcgaacagctctacaccgacctggccgaggggcaggccaacgagttgcgcgagttgcgccgcaacggagccgaccggcccgtggtcgagaccgtcagccgcgccgcggtcgcactgctcggtgcctccgtcacggatctgcggtccgatgcgcacttcaccgatctgggtggagattcgttgtcggccttgagcttctcgaacctgttgcacgagatcttcgatgtcgacgtgccggtcggcgtcatcgtcagcccggccaccgacctggcaggcgtcgcggcctacatcgagggcgaactgcgcggctccaagcgccccacatacgcgtcggtgcacgggcgcgacgccaccgaggtgcgcgcgcgtgatctcgccctgggcaagttcatcgacgccaagaccctgtccgccgcgccgggtctgccgcgttcgggcaccgagatccgcaccgtgctgctgaccggcgccaccgggttcctgggccgctatctggcgctggaatggctggagcgcatggacctggtggacggcaaggtgatctgcctggtgcgcgcccgcagcgacgacgaggcccgggcgcgtctggacgccacgttcgacaccggggacgcgacactgctcgagcactaccgcgcgctggcagccgatcacctcgaggtgatcgccggtgacaagggcgaggccgatctgggtctcgaccacgacacgtggcagcgactggccgacaccgtcgatctgatcgtcgatccggccgccctggtcaatcacgtcctgccgtacagccagatgttcggacccaatgcgctcggcaccgccgaactcatccggatcgcgctgaccaccacgatcaagccgtacgtgtacgtctcgacgatcggtgtgggacagggcatctcccccgaggcgttcgtcgaggacgccgacatccgcgagatcagcgcgacgcgccgggtcgacgactcgtacgccaacggctacggcaacagcaagtgggccggcgaggtcctgctgcgggaggcgcacgactggtgtggtctgccggtctcggtgttccgctgcgacatgatcctggccgacacgacctactcgggtcagctgaacctgccggacatgttcacccgcctgatgctgagcctcgtggcgaccggcatcgcgcccggttcgttctacgaactcgatgcggacggcaaccggcagcgcgcccactacgacgggctgcccgtggagttcatcgccgaggcgatctccaccatcggctcgcaggtcaccgacggattcgagacgttccacgtgatgaacccgtacgacgacggcatcggcctcgacgagtacgtggactggctgatcgaggccggctaccccgtgcaccgcgtcgacgactacgccacctggctgagccggttcgaaaccgcactgcgggccctgccggaacggcaacgtcaggcctcgctgctgccgctgctgcacaactatcagcagccctcaccgcccgtgtgcggtgccatggcacccaccgaccggttccgtgccgcggtgcaggacgcgaagatcggccccgacaaggacattccgcacgtcacggccgacgtgatcgtcaagtacatcagcaacctgcagatgctcggattgctgtaa

SEQ ID NO: 32 - protein, 1168 aa, Mycobacterium smegmatis; identical to SEQ ID NO: 20

SEQ ID NO: 33 - DNA, 3525 bp, Mycobacterium intracellulare
atgtcgactgccattcatgacgaacacctcgaccgtcgcatcgaggaactcatcgccaacgacccccaattcgccgccgcccgaccggacccggccatcaccgccgccaccgaagcgcccgggctgcggctgccgcagatcatccggaccgtgctcgacggctacgccgaccggcctgccctggcgcagcgcgtcgtggagttcgtcaccgacgccaagaccgggcggacgacggccgagctgctcccccgtttcgagaccatcacgtatggcgaactcggcgaacgggtttcggccctcggccgtgcctgggccggcgacgcggtgcgccccggcgaccgcgtctgcgtgctcggcttcaacagcgttgactacgccaccatcgacatcgcgctgggcaccatcggggccgtgtcggtgccgctgcagaccagcgcggcgatctcctcgttgcagccgatcgtcgccgagaccgagcccagcctgatcgcctcgagcgtcaaccagctgcccgacgcggtggagctgatcctggccggcgaccacgtgcccggcaagctcgtcgtgttcgactaccagccccaggtcgacgaccagcgcgaggccgtggaggccgccgccgcgcggttggccgactccggcgtcgcggtcgaggctctcgccgacgtgctgcggcgcggcaaggacctgccggccgtcgagccgccggcgagcgacgaggactcgctggccctgctgatctacacctccggcagcaccggcgcgcccaagggcgcgatgtacccgcagagcaacgtcggcaagatgtggcggcgcgggagcaagaactggttcggggaaagcgccgcgtcgatcaccctcaacttcatgccgatgagccacgtcatggggcgcggaatcctctacggcacgctgggcaacggcggcaccgcgtacttcgccgcccgcagcgacctgtccaccctgctcgaggacctcgagttggtgcggcccaccgagatgaacttcgtcccccgcatctgggagacgctgtacggcgaattccagcgccaggtcgagcggcggctggccgacggcgatgcgggcccggaggcccgcgagactgtggcggctgcggtgttggaagaacagcgccagtacctgctgggcgggcggttcatcttcgcgatgacgggctcggcacccacctcgccggagctcaaggcgtgggccgagtcgctcctgcagatgcacctgatggacggctacggctccaccgaggccggaatggtgttgttcgacggggagattcagcgtccgccggttattgattacaagctggtcgacgttccggatctgggctatttcagcaccgaccgtccgcatccgcgcggtgagttgttgctgcggaccgagaacatgttcccgggttattacaagcgggccgagaccaccgcgaacgtgttcgacgaggacggttattaccgcaccggtgacgtgttcgccgagatcgcgccggaccggctggtgtatgtcgatcgccgcaacaacgtgctcaagttggcccagggcgagttcgtgacgctggccaagctggaggcggtgttcggcaacagcccgctgatccgccagatctacgtttacggcaacagctcccagccctacctgctggccgtggtggtgccgaccgaggaagcgttggcggacaacgatcttgagtcgctcaagccgaagatcgccgactcgctgcagaaggtcgccaaggagaccggcctgcagtcctacgaggtgccgcgcgacttcatcatcgagaccacgccgttcaccctggaaaacggcctgctgaccgggatccgcaagctggcgtggcccaagctcaaggcgcactacggggatcggctcgagcagatgtatgccgagctggccgcgggacaggccaacgagttggccgaactgcgccgcagcggcgcggcggcgccggtggcccagaccgtgagccgggccgcggccgccctgctgggtgcgacggccggggatctgtccgcagatgcccacttcaccgatcttggtggagactcgttgtcggcgttgaccttcggcaacctgctgcgcgagatcttcgatgtcgacgtgccggtgggggtgatcgtcagcccggccaacgacctggcggggatcgccgcctacatcgaggccgagcggcagggctccaagcgcccgacgttcgccgccgtgcacggtcgcggtgcgaccatggtgcacgccagtgacctcacgctggacaagttcctcgacgaggcgaccctggccgccgcgcccagcctgcccaagccggccaccgaggtgcgcaccgtgctgttgaccggcgcgaccggctttttgggccgctacctggcgctggactggctcgagcggatggacatggtcgacggcaaggtcatcgccctggtgcgggcccgcaccgatgaggaggcgcgcgcccggctggacaagaccttcgacagcggcgaccccaaactgctggcgcactaccagcggctggccgccgaccacctcgaggtcatcgccggcgacaagggtgaggccaacctcggcctggacccccagacctggcagcgactggccgaggaggtcgacgtcatcgtcgaccccgccgcgctggtcaaccacgtgctgccctacagcgagctgttcggccccaacgccctgggcaccgcggagctgatccggatcgcgctgacctccaggcaaaagccctacacctacgtgtcgacgatcggggtgggcgatcagatccagccaggtgagttcgtcgagaacgccgacatccgccagatcagcgccacccgcgagatcaacgacggctacgccaacggctacggcaacagcaagtgggccggcgaggtgttgctgcgcgaggcccacgacctgtgcggcctgcccgtcacggtgttccgctgcgacatgatcctggccgacaccacctatgccgggcagctcaacctgcccgacatgttcacccggctgatgctgagcctggtcgccaccggtatcgcgcccgggtcgttctacgaactggacgccgacggcaaccgccagcgggcacactacgacggtttgccggtcgagttcatcgccgcggcgatctcgacgctggggacccaaatcaccgacagcgacacgggctttcagacctaccacgtgatgaacccctacgacgacggcatcgggctggatgagtacatcgattggctgatcgaggccgggtattcgatcgagcggatcgccgattactccgagtggctgcggcgcttcgagacctcgctgcgggccctgcccgatcggcagcgtcagtactcgctgctgccgctgctgcacaactaccagaagccggaaaagccgatcaacggctcgatggcgcccaccgacgtgttccgtgccgcggtgcaggaagcgaaaatcggccccgacaaagacatcccgcacgtctcggcgccggtgatcgtcaagtacatcaccgacctggagttgctcggactcctctga

SEQ ID NO: 34 - protein, 1174 aa, Mycobacterium intracellulare
MSTAIHDEHLDRRIEELIANDPQFAAARPDPAITAATEAPGLRLPQIIRTVLDGYADRPALAQRVVEFVTDAKTGRTTAELLPRFETITYGELGERVSALGRAWAGDAVRPGDRVCVLGFNSVDYATIDIALGTIGAVSVPLQTSAAISSLQPIVAETEPSLIASSVNQLPDAVELILAGDHVPGKLVVFDYQPQVDDQREAVEAAAARLADSGVAVEALADVLRRGKDLPAVEPPASDEDSLALLIYTSGSTGAPKGAMYPQSNVGKMWRRGSKNWFGESAASITLNFMPMSHVMGRGILYGTLGNGGTAYFAARSDLSTLLEDLELVRPTEMNFVPRIWETLYGEFQRQVERRLADGDAGPEARETVAAAVLEEQRQYLLGGRFIFAMTGSAPTSPELKAWAESLLQMHLMDGYGSTEAGMVLFDGEIQRPPVIDYKLVDVPDLGYFSTDRPHPRGELLLRTENMFPGYYKRAETTANVFDEDGYYRTGDVFAEIAPDRLVYVDRRNNVLKLAQGEFVTLAKLEAVFGNSPLIRQIYVYGNSSQPYLLAVVVPTEEALADNDLESLKPKIADSLQKVAKETGLQSYEVPRDFIIETTPFTLENGLLTGIRKLAWPKLKAHYGDRLEQMYAELAAGQANELAELRRSGAAAPVAQTVSRAAAALLGATAGDLSADAHFTDLGGDSLSALTFGNLLREIFDVDVPVGVIVSPANDLAGIAAYIEAERQGSKRPTFAAVHGRGATMVHASDLTLDKFLDEATLAAAPSLPKPATEVRTVLLTGATGFLGRYLALDWLERMDMVDGKVIALVRARTDEEARARLDKTFDSGDPKLLAHYQRLAADHLEVIAGDKGEANLGLDPQTWQRLAEEVDVIVDPAALVNHVLPYSELFGPNALGTAELIRIALTSRQKPYTYVSTIGVGDQIQPGEFVENADIRQISATREINDGYANGYGNSKWAGEVLLREAHDLCGLPVTVFRCDMILADTTYAGQLNLPDMFTRLMLSLVATGIAPGSFYELDADGNRQRAHYDGLPVEFIAAAISTLGTQITDSDTGFQTYHVMNPYDDGIGLDEYIDWLIEAGYSIERIADYSEWLRRFETSLRALPDRQRQYSLLPLLHNYQKPEKPINGSMAPTDVFRAAVQEAKIGPDKDIPHVSAPVIVKYITDLELLGLL

SEQ ID NO: 35 - DNA, 3522 bp, Mycobacterium smegmatis; identical to SEQ ID NO: 21

SEQ ID NO: 36 - protein, 1173 aa, Mycobacterium smegmatis; identical to SEQ ID NO: 22

SEQ ID NO: 37 - DNA, 3525 bp, Mycobacterium kansasii
atgtcgactaccactcgtgacgagcgcctcgagcgccgcatcgacaccctgatccacgacgacgcacagttcgccgccgccaagccggacccggcaatcgccgccgccctggaaaagcccggcctgagcctgccagagatcatccagaccgcgctgcagggctacgccgaccggccggctctcgggcagcgcgccgtcgagttcgtcacggacacccagaccggccgcacctcggtgcggctgctgacccgcttcgagaccatcacctaccgtcagctcggcgaccgggtcggtgcgctggcgcgcgccctgacccacgactcggtgcacgccggcgaccgggtctgcgtgctgggcttcaacagcctcgactacaccaccatcgacatggcgctggcgaaggtcggcgcggtgtcggtgccgctgcagaccagtgcggcggttacccagctgcagccgatcgtggccgagaccgagcccaccatgatggcggccagtgtgaatcagctgtcggatgccgtggacgtgctgttgagcggccacctgccggccaagctggtggtgttcgactaccaccccgaggtggacgaccagcgcgaggcgctcgacacggcccgggagcggttggcggacacagcggtggttgtccagaccctcaaggacgtcctggaccacggcgcaacgctggcggcggggtcggttgccgagccgctcgcggcgtcgggcgacaacgactcgctggcgctgctgatctacacctccggcagcaccggcgcacccaaaggtgcgatgtatcgacagagcaacgtcggcaagatgtggcgccggtcgagcaagaactggttcgggcccaccgcggcgtcgatcaccctcaacttcatgccgatgagccacatcatgggacgtggagtcctctacggcacgctcggcaacggcggcaccgcgtacttcgcggccaggagcgacctctcgacgctgctggaagacttgcggctggtgcggcccaccgagttgaacttcgtgccgcggatctgggagaccttgtacggcgaataccagcgcgcggtcgaccagcggtcggtcgatcccggtgaacccgccgcccgcgaagccgtcgaagcccaggtcatggccgagcagcgccaggacctgctgggtgggcgctatatcttcgcgatgacgggctcggcgcccatgtccccggagctgcggaactgggtggaagcgctgctggagatcccactgctcgacggttacggctccaccgaggccgggatggtcatgttcgacggtgaaattcagcgcccgccggtgatcgactacaagctggtcgacgtgcccgatctgggctacttcagcaccgaccagccgtatccgcggggcgagttgctgctcaagaccgagaacatgttcccaggctattacaagcggccggaggttacggccagcgtgttcgacgcggacggctactaccggaccggagacgtcgtggccgaggtcgctccggaccggctggtgtacgtggaccgccgcaacaacgtgctgaagcttgcccagggcgagttcgtgaccgtcgccaagctggaggcggtgttcggcaacagcccgctggtgcgccagatctacgtctacggcaacagcgcgcatccctacctgttggccgtggtggtgccaacggaagaagcgtcggcgggcactgacatagcggccttgaagccgctgatcgccgactcgctgcagaccgtcgccaaagaggccggcctgcagtcctacgaggtgccgcgcgacttcctcatcgagacaacaccattcacgctggagaacggtctgctcaccggtatccgcaagctggcgtggccgaagctgaggcagcattacggcgaacggctggagcagctctacacggagctggccgcgagccaggccaacgagttgagcgagctgcggcgcagcggggcccatgcgccggtgctggaaacggtgagccgggcggcgggcgcgctgctgggggcggcgagcaccgccttgtcacccgacgcgcacttcaccgatctgggtggagactcgttgtcggcgttgacattcggcaacctgctgcgggagatcttcgacgttgacgtaccggtgggtgtgatcgtcagcccggccagcgacctggcggcgatcgccgcttacatcgagggcgagcggcagggcagcaagcgacccacgttcgccgtgattcacggtcgggacgcgctagaggtgcatgcgagtgacctcaccctggacaagttcatcgacgcatccaccctggcagccgcaccggtactgccgcctccgagcgccgcggtgcgcaccgtcctgttgaccggcgcgaccggctttttgggccgctacctggcgctggactggctggagcgcatggacctggtcgacggcaaggtgatcgccctggtgcgggcgaagtcggacgacgatgcccgggcacgcctggacaagacgttcgacagcggagaccccgagctgctgacccactaccggcggctggcgaccgaccacttggaggtcatcgccggcgacaagggcgaggccaacctcgggctggatcagctgacctggcagcggctggccgacaccgtcgacctgatcgtcgacccggccgcgttggtcaaccacgtgctgccctacagcgagctgttcggccccaacgcgctgggcaccgccgaattgatccggatagcgctgaccggcaagctcaagccctacacctacgtctcgaccatcggggtgggcgaccagatcgagccgggcaagttcaccgaggacgccgacatccggcacatcagcgcgacccggaagatcaacgacagttacgccaacggctacggcaacagcaagtgggccggcgaggtgctactgcgcgaggcccacgacctgtgcgggctgccggtcgcggtgttccgctgcgacatgatcctggccgacaccacgtgggcgggtcagctcaacgtgccggacatgttcacccggatgatgctgagcctggtggccaccggcattgcacccggttcgttctacgagctggacgccgacggcaaccggcagcgtgcccactacgacggcttgccggtcgagttcatcgccgaggcgatcgcgacgctgggcgcccgggacgggaagggtttccagacctaccacgtgatgaacccctacgacgacggcatcgggatggaccggttcgtcgactggctcgtcgacgccggatgcgccatccaccgcatcgacgactacggcgactggctgcgacgattcgagaccgcgctgcgcggcctgcccgaaaagcagcgtcacgcgtcactactgccgttgctgcacaactaccagaagccggcgccgccgctgcgcgggtcgatggctccgaccgaccggttccgggcggccgtgcaggacgcgaaagtgggcccggacaaggacatcccgcacatctcgccgcagatcatcgcgaagtacctcagtgatctgcgcttgctcgggctcctctga

SEQ ID NO: 38 - protein, 1174 aa, Mycobacterium kansasii
MSTTTRDERLERRIDTLIHDDAQFAAAKPDPAIAAALEKPGLSLPEIIQTALQGYADRPALGQRAVEFVTDTQTGRTSVRLLTRFETITYRQLGDRVGALARALTHDSVHAGDRVCVLGFNSLDYTTIDMALAKVGAVSVPLQTSAAVTQLQPIVAETEPTMMAASVNQLSDAVDVLLSGHLPAKLVVFDYHPEVDDQREALDTARERLADTAVVVQTLKDVLDHGATLAAGSVAEPLAASGDNDSLALLIYTSGSTGAPKGAMYRQSNVGKMWRRSSKNWFGPTAASITLNFMPMSHIMGRGVLYGTLGNGGTAYFAARSDLSTLLEDLRLVRPTELNFVPRIWETLYGEYQRAVDQRSVDPGEPAAREAVEAQVMAEQRQDLLGGRYIFAMTGSAPMSPELRNWVEALLEIPLLDGYGSTEAGMVMFDGEIQRPPVIDYKLVDVPDLGYFSTDQPYPRGELLLKTENMFPGYYKRPEVTASVFDADGYYRTGDVVAEVAPDRLVYVDRRNNVLKLAQGEFVTVAKLEAVFGNSPLVRQIYVYGNSAHPYLLAVVVPTEEASAGTDIAALKPLIADSLQTVAKEAGLQSYEVPRDFLIETTPFTLENGLLTGIRKLAWPKLRQHYGERLEQLYTELAASQANELSELRRSGAHAPVLETVSRAAGALLGAASTALSPDAHFTDLGGDSLSALTFGNLLREIFDVDVPVGVIVSPASDLAAIAAYIEGERQGSKRPTFAVIHGRDALEVHASDLTLDKFIDASTLAAAPVLPPPSAAVRTVLLTGATGFLGRYLALDWLERMDLVDGKVIALVRAKSDDDARARLDKTFDSGDPELLTHYRRLATDHLEVIAGDKGEANLGLDQLTWQRLADTVDLIVDPAALVNHVLPYSELFGPNALGTAELIRIALTGKLKPYTYVSTIGVGDQIEPGKFTEDADIRHISATRKINDSYANGYGNSKWAGEVLLREAHDLCGLPVAVFRCDMILADTTWAGQLNVPDMFTRMMLSLVATGIAPGSFYELDADGNRQRAHYDGLPVEFIAEAIATLGARDGKGFQTYHVMNPYDDGIGMDRFVDWLVDAGCAIHRIDDYGDWLRRFETALRGLPEKQRHASLLPLLHNYQKPAPPLRGSMAPTDRFRAAVQDAKVGPDKDIPHISPQIIAKYLSDLRLLGLL

SEQ ID NO: 39 - DNA, 3507 bp, Mycobacterium bovis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctactacgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 40 - protein, 1168 aa, Mycobacterium bovis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYYVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 41 - DNA, 3489 bp, Mycobacterium intracellulare
ttggccgcgaccgacgaacagttccgcaacgcccaacccgatctgtcgctgcagcaggcggcgcgccaaccgggcctgcgcctgccccagattctggagctgttcgtcgagggctacgccgatcggcccgcggtgggctggcgggccaggacactgagcaccgaccccgcgaccgggcgtaccaccacgcgactgctcccccgcttcgacaccatgacctaccgcgagctgtgggccgatgtgcgcgcgatcgccgccgcgtggcggcacgacgccgcgaaccccgtgtcgcccggggacttcgtcgcgacggtcggtttcgccagcgccgaatatctgaccctcgacctggtctgcggctacctcgggctggttgccgttccgctgcaacacaatacgaccccctcacggctgcgaccgatcgtcgacgaggtcgagccgtcgatactggccgccggcgtcggttatctcgacctcgcggtcgaggcggcgtcgggcagctcgtcgttgcggcggctcgtggtcttcgattaccagcccgaggtcgacgagcaacgcgaggcgctgcagcgcgcccaggcgacgctggcggccgccggcgcggcggtgaccatcgagaccctcgacgaaatcatcgaacgcggacgcgccctgccgcccgagcccatgtacaccggtgataccgatcagcggctggcgatgatcatgtacacctcgggcagcaccgggttacccaagggcgccatgtacaccgagcagatgctggccaaggtgtggaccaacgagctgatgcccgacttcgcggacacacccgtgttcaacgtcaacttcatgccgctgaatcacctcggtggccggataccgctgtcgaccgcgttccaggccggcggcaccagctatttcgtgccggaaagcgacctgtccacgttgttcgacgactggaacctggtgcgccccaccgagatgggcctggtaccccgggtggcggaaatgctctaccagcgctaccagagcgccgtcgaccgactcgtggcttcgggcgccgacgccggctccgccgaggcccgggcgcgggccgagctgcgtgagcatgtcctcggcgggcgcatcgtgaccgccttctgcgggacggcgccgctggccgcggagatgcgggccttcgtcgaaacctgtttggacgtccacgttctcgacggctacgggctgaccgaggtcggcatggtgaccaaggacgggcgcatgacccgtcccccggtgctcgactacaagctcatcgacgttcccgaactcggctatttccacaccgacaagccttatccgcgtggcgaattgctggtgaagtcgctgaccgcgacgccgggctacttcaaacgaccggacgtcaccgccaacgcgttcgatcccgacggctactaccggaccggcgatgtgatggccgagctcgagccggaccggctggcctacgtcgaccgccgcaacaacgtgttgaagttggcgcagggcgagttcgtcgccgtcgcccgcctggaggccgtcttcgccagcgcgccgctgatccgccagatcttcgtatacggcaacagcgaacgcccctatctgctggccgtcgtcgtgccgacggccgacgccgcggagcgattcaccggagatcccgagggcctcaaggccgccgtcgccgaatccctgcgccagtcggcgcaactcgccgaactgcagtcctacgaggtgcccgtcgacttcgtcgtcgagaccgagccgttcagcgaggacaacggcctgctctcgggcgtgggcaagctgctgcggccgaagctcaaggagcgctacgccgaccggctcgaacagctctacgccgagctggccgaaaaccgcgtgaccgagttgcgtgcgctgcgcgagggggcggacaaacaccccgtcgtcttcaccctcacccgggccgccgaggcgctactgggtgtggccggcggcccgcccgcccccgacgcactgttcatcgaactcggcggcgattccctgtcggcgctgaccttctccaacctgctgcgcgacatcttcgacgtcgacgtgccggtgggaatgatcaccgggcccgcgaccgacctgggccagctcgcggaatacgttgaatccgaacgcaaatcgggatcacgccggcccacattcgcgacggtgcacggacgcggcgccgccgaggtccgcgccgcggagctcaccctcgacaagttcatcgacgcgacgaccttggccgccgcaccgaacctgccgcgcgcgaccggcacaccccacacggtcctgctgaccggcgccaacggctacctcggccgcttcctggccctcgaatggctcgagcgcctcgccgagaccggcgggaagctcgtctccatcgtccgcgcgacggacaccgcggcggccgtcaaacggctggaggccgttttcgacagcggggatccgcagttgctggagcggttccggacgctggccgccgagcacctggaagtcatcgtcggcgacatcggtgagcccaatctcggcctggaccaagcgacttggcagcgcctggcccagagcgtggatctgatcgtccacccggccgcgttggtcaaccacgtgctgccgtacgaccaactgttcggtccgaacgtcgtcggcaccgccgagttgatccgcctggcgatcacgacgcgcatcaagcccgtcacctatctgtcgaccgtcgccgtggcgatgacggtcgatcccggcgagttcgccgaagacggcgacatccgcgcggtcagcgcggtacgcccgatcgacgacagctacgcgaacgggtacgcgaacagcaagtgggccggtgaggtgttgctgcgtgaggcgcacgacctgtgcgggttgccggtcgccgtcttccgctccgacatgatcctcgcgcacagccggtatgccgggcagctgaacgtgccagatgccttcacccgcttgatgttcagcctgctgaccaccggcatcgcgccgaccacgttctaccggaccgacgaacacggaaaccgagccgtggcccactacgacgggctgcccgccgacttcgtggccgaagcggtcaccacgctcggcgaacagatggcggccgaggaatccggcgggtaccgctcctatgacgtgatgaacccacacgacgacggcgtctccctggacgtgttcgtcgactggctgatcgccgccggacacgacatccggcgcatcgaggactatgacgaatggctgggccgcttcaccacggcgcttcgcgcgttaccggacaagcagcgccagcattcggtgttgccgctgctggacgcctaccgggaacccgcgacgccactgcggggagcgccggcccccaccgacgtcttccgccacgcggtgcggacggccaaaatcggtgcggacgaggacattccgcacctgtcggcggcgttgatcgacaagtacgtcgccgacctacgcctgctgggcttggtgtag

SEQ ID NO: 42 - protein, 1162 aa, Mycobacterium intracellulare
MAATDEQFRNAQPDLSLQQAARQPGLRLPQILELFVEGYADRPAVGWRARTLSTDPATGRTTTRLLPRFDTMTYRELWADVRAIAAAWRHDAANPVSPGDFVATVGFASAEYLTLDLVCGYLGLVAVPLQHNTTPSRLRPIVDEVEPSILAAGVGYLDLAVEAASGSSSLRRLVVFDYQPEVDEQREALQRAQATLAAAGAAVTIETLDEIIERGRALPPEPMYTGDTDQRLAMIMYTSGSTGLPKGAMYTEQMLAKVWTNELMPDFADTPVFNVNFMPLNHLGGRIPLSTAFQAGGTSYFVPESDLSTLFDDWNLVRPTEMGLVPRVAEMLYQRYQSAVDRLVASGADAGSAEARARAELREHVLGGRIVTAFCGTAPLAAEMRAFVETCLDVHVLDGYGLTEVGMVTKDGRMTRPPVLDYKLIDVPELGYFHTDKPYPRGELLVKSLTATPGYFKRPDVTANAFDPDGYYRTGDVMAELEPDRLAYVDRRNNVLKLAQGEFVAVARLEAVFASAPLIRQIFVYGNSERPYLLAVVVPTADAAERFTGDPEGLKAAVAESLRQSAQLAELQSYEVPVDFVVETEPFSEDNGLLSGVGKLLRPKLKERYADRLEQLYAELAENRVTELRALREGADKHPVVFTLTRAAEALLGVAGGPPAPDALFIELGGDSLSALTFSNLLRDIFDVDVPVGMITGPATDLGQLAEYVESERKSGSRRPTFATVHGRGAAEVRAAELTLDKFIDATTLAAAPNLPRATGTPHTVLLTGANGYLGRFLALEWLERLAETGGKLVSIVRATDTAAAVKRLEAVFDSGDPQLLERFRTLAAEHLEVIVGDIGEPNLGLDQATWQRLAQSVDLIVHPAALVNHVLPYDQLFGPNVVGTAELIRLAITTRIKPVTYLSTVAVAMTVDPGEFAEDGDIRAVSAVRPIDDSYANGYANSKWAGEVLLREAHDLCGLPVAVFRSDMILAHSRYAGQLNVPDAFTRLMFSLLTTGIAPTTFYRTDEHGNRAVAHYDGLPADFVAEAVTTLGEQMAAEESGGYRSYDVMNPHDDGVSLDVFVDWLIAAGHDIRRIEDYDEWLGRFTTALRALPDKQRQHSVLPLLDAYREPATPLRGAPAPTDVFRHAVRTAKIGADEDIPHLSAALIDKYVADLRLLGLV

SEQ ID NO: 43 - DNA, 3507 bp, Mycobacterium tuberculosis; identical to SEQ ID NO: 17

SEQ ID NO: 44 - protein, 1168 aa, Mycobacterium tuberculosis; identical to SEQ ID NO: 18

SEQ ID NO: 45 - DNA, 3489 bp, Mycobacterium vanbaalenii
atgtctactgatacccgcgaagaccgccttgcccgccgcatcgccgatctgtacgccaccgacccgcagtttgccgccgcagcacccgacgacgccatctcccacgccatcgatcaaccagggacgcacctgcccgtcatcgtgcagaccgtcctcgacggatacgccgagcggcccgcgctcggacagcgcgcggtccgtttcgtcaccgaccccgccacgggcagaaccaccaccgagctgctcccccgcttcgagaccatcacctacgccgagttgtcacgccgcatccacgcggtcaccgccgcgctgaccgatgtgcatccgggcgaccgcgtggcggtgctgggcttcaccagcatcgactacaccaccgtcgacatggctttggcgatgctgggcgcggtggcggtaccacttcagaccagcgcgccggccaccaccgtccggccgatcgtcgccgagaccgaaccggtggtcatcgcatcgtcggtcgatgccctcaccgacgccgtcggcctggctctcgacgctcccaccgtgacccgccttgtggtcttcgatcatcgcgccggggtcgacgatcatcgcgacgccctcatctccgcgagcgaccggttgcgcgccgccaactcgccgatcgaggtcgagaccattaccgacatcgtcgctcggggttcgaaactgcctgtacgcgcgcaattctcggccgacggtgacgcgctgagcctgctgatctacacctccggcagcaccggcgcacccaagggtgcgatgtacccccaacacctggtcgccaactcatggcggcggttggcccggtccttctggggcgacctgggggtcttcccggcaatcacgctgaacttcatgccgatgagccacgtgatgggccgcggactgctctacggcacgctggacgccggcggcaccgcgtatttcgcggccaggagcgatctgtcgacgttcctggaggatctcgccctggtgcgcccgacgcagctgagcttcgtgccgcggatctgggacaccatccacgccgaggtgtcccaggaactcgagcgccggccgtcggatgcgaccgaggtgatcgccgatctgcggcggagcctgctgggcggccgctacgtcacggcgatgacgggctccgcgccgctgtcaccggagatgcgggccttcgtcgagaacctgctcgacgtgcacctgatcgacgggtacggctcgaccgaggccggcgcggtgttcgtcgacggccgggtccaacgcccgccggtcatcgattacaagctcgtcgacgtcgccgacctcggctacttctccaccgaccgcccccatccgcgcggcgagcttctcgtcaaatccgagacgctgtttcccggctactacaaacgccccgacgtcaccgccgagatgttcgacgaagacggctactaccgcaccggcgacatcgtcgccgagaccggggccgaccagctgacctatctggaccgccgcaacaacgtcctcaaactgtcgcagggcgaattcgtcaccgtctcccgactggaggcagtgttcggcaacagcccgctggtccgccagatctacgtctacggcaacagcgcccgcccctacctgctggctgtggtcgtgcccaccgaagccgcgctggccggtgctgacgccaaagccgctgtggccgagtcacttcaggatgtcgccaaggcgaccgggctgcagtcctacgagatcccccgcgatttccttctcgagacgacgccgttcacgctggagaacggcttgctgaccggcatccgaaaactggcccgccccagactcagagagcgttacggcgaacagctcgaggccctctacaccatgctgtccgaagagcaggccgacgagctgcgggagctgcgccgctccggcggagagcgtccggcgctggaaaccgtcggacgcgccgccggggcgctgctcggcaccaccgcaggcgagctggagccgagcgcccacttcacagatctgggcggggattcgctgtcggcgttgaccttcgccaacctgctgcgcgacatcttcgacgtcgacgtccccgtcggtgtgatcgtcagcccggccaccgatctgcaggcccttgccgactacgtcgagtccgcccgccggcacgggtcggtgcggcccactttcgaatcggtgcacgggcattcgggacgacccgggaccgaggtgcatgcccgcgatctgacgttggacgaattcgtcgacgccgcgaccctggcgcacgcgccgacgttgcccggaccgcgcgccgaggtccgcaccgtcctgctgaccggggcgaccggcttcctcggccggtatctcgctctcgaatggcttgagcggatggcgctggtcggcggcaagctgatctgcctggtccgcgccaaagacgatgcggcagcgcgggttcggctggacagcacgttcgacagcggggacccggagctgctgcggcactaccgacggctggcagccgaccatctcgaagtgatcgccggcgacaaggccgacgccgatctcggactcgacgcgcggacgtggcagcggctcgcggacaccgtcgatctgatcgtcgatcccgccgccctggtcaaccacgtcctgccgtaccgccaactgttcgccccgaacgtgctcggcaccgccgaactgctccgcatcgcgctgacaacgaggatgaagccgttcgtgtacgtgtcgacgatcggcgtcggcgccggtatcgaacccgcgaggttcaccgaggacgccgacatcaggcagatcagcgcgacgcgcagaatcgacgacagctacgccaacggctacggcaacagcaagtgggccggcgaggtgctgctgcgcgaggcgcacgatctgtgcggcctgcccgtttcggtgttccgctgcgacatgatcctggccgacaccacctacgccggtcagctgaacctgccggacatgttcacccgcctgatcttcagcctggtcgccaccggcgtcgcgcccgagtcgttctaccacctcgccaccgacggcacccggcaacgggcccactatgacgggctaccggtggagttcatcgccgaagcgatctcgaccctcggctctgacgtcgcctccgggttccggacgtatcacgtgatgaatccccacgacgacgggataggcctcgacgagtacgtggactggctcatcgacgcaggccatccgattcgacgcgtcggcgactacccgacgtggctgcaacggttcacggtggcgatcaccgcgctgccggaacggcagcggcaggcctcactgttgccgctgctgcacaactaccagcacccggagacgccgatccgcggctccatcgcaccgacagacagattccgtgaagcggtccaggacgccaaaatcggtccggacaaagacattccacacgtgacaccgcagatcgtcatcaagtacgtcaccgacctgcagcgactcggactgctctaa

SEQ ID NO: 46 - protein, 1162 aa, Mycobacterium vanbaalenii
MSTDTREDRLARRIADLYATDPQFAAAAPDDAISHAIDQPGTHLPVIVQTVLDGYAERPALGQRAVRFVTDPATGRTTTELLPRFETITYAELSRRIHAVTAALTDVHPGDRVAVLGFTSIDYTTVDMALAMLGAVAVPLQTSAPATTVRPIVAETEPVVIASSVDALTDAVGLALDAPTVTRLVVFDHRAGVDDHRDALISASDRLRAANSPIEVETITDIVARGSKLPVRAQFSADGDALSLLIYTSGSTGAPKGAMYPQHLVANSWRRLARSFWGDLGVFPAITLNFMPMSHVMGRGLLYGTLDAGGTAYFAARSDLSTFLEDLALVRPTQLSFVPRIWDTIHAEVSQELERRPSDATEVIADLRRSLLGGRYVTAMTGSAPLSPEMRAFVENLLDVHLIDGYGSTEAGAVFVDGRVQRPPVIDYKLVDVADLGYFSTDRPHPRGELLVKSETLFPGYYKRPDVTAEMFDEDGYYRTGDIVAETGADQLTYLDRRNNVLKLSQGEFVTVSRLEAVFGNSPLVRQIYVYGNSARPYLLAVVVPTEAALAGADAKAAVAESLQDVAKATGLQSYEIPRDFLLETTPFTLENGLLTGIRKLARPRLRERYGEQLEALYTMLSEEQADELRELRRSGGERPALETVGRAAGALLGTTAGELEPSAHFTDLGGDSLSALTFANLLRDIFDVDVPVGVIVSPATDLQALADYVESARRHGSVRPTFESVHGHSGRPGTEVHARDLTLDEFVDAATLAHAPTLPGPRAEVRTVLLTGATGFLGRYLALEWLERMALVGGKLICLVRAKDDAAARVRLDSTFDSGDPELLRHYRRLAADHLEVIAGDKADADLGLDARTWQRLADTVDLIVDPAALVNHVLPYRQLFAPNVLGTAELLRIALTTRMKPFVYVSTIGVGAGIEPARFTEDADIRQISATRRIDDSYANGYGNSKWAGEVLLREAHDLCGLPVSVFRCDMILADTTYAGQLNLPDMFTRLIFSLVATGVAPESFYHLATDGTRQRAHYDGLPVEFIAEAISTLGSDVASGFRTYHVMNPHDDGIGLDEYVDWLIDAGHPIRRVGDYPTWLQRFTVAITALPERQRQASLLPLLHNYQHPETPIRGSIAPTDRFREAVQDAKIGPDKDIPHVTPQIVIKYVTDLQRLGLL

SEQ ID NO: 47 - DNA, 3525 bp, Mycobacterium sp.
atgtccaccgagacccgtgaagcgcgcctgcagcagcgcatcgcgcatctgttcaccaccgacccgcagttcgccgccgcccggcccgacccccggatcagcgatgccgtcgaccgcgatgacacgcggctgaccgccatcgtctccgcggtcatgtcggggtacgccgaccggccggcactcgggcagcgcgccgccgaattcgtcaccgacccgcagaccggccgcaccacgatggagctgctcccccgcttcgacaccatcacctaccgggagctgctcgaccgcgtccgggcgctcaccaacgcgtggcacgccgacggggtgcgccccggcgaccgtgtcgcaatcctcggattcaccggcatcgactacaccgtggtcgacctcgccctgatccagctcggcgcggtcgcggtgccgctgcagaccagcgccgccgtggaggcgttgcgcccgatcgtggccgagaccgaaccgatgctcatcgccaccggcgtcgatcatgtcgacgccgccgcggaactcgcactcaccggccaccgtccgtcccgggtggtggtcttcgaccaccgcgagcaggtcgacgacgaacgcgacgcggtgcgggccgcgacggccaggctgggagacgccgtccccgtcgagacactcgccgaggtgttgcggcggggcgcccatctgcccgccgtggcgccgcacgtgttcgacgaggccgatccactgcggctgctgatctacacttccggcagcgccggcgcccccaagggcgcgatgtatcccgagagcaaggtcgccggcatgtggcgcgcgtcggccaaggccgcctggaacaacgatcagacagcgattccgtcgatcaccctgaacttcctgccgatgagccacgtcatgggtcgcggcctgctgtgcggcacgctcagcaccggtggcaccgcgtatttcgccgcccgcagcgatctgtcgacgctgctcgaggacctgcgcctggtacggcccacccaactcagcttcgtgccgcggatctgggacatgctcttccaggagttcgtcggcgaggtcgaccggcgggtgaacgacggtgcggaccgccccaccgcggaggccgacgtgctggccgtacagcgtcacgagctgctcggtggccggttcgtcaccgcgatgaccggttcggcgcccatctccctcgagatgaagacatgggtggagaccctgctcgacatgcacctggtcgagggttacggctcgacggaggccggcgcggtgttcgtcgacggccacatccagcgcccaccggtgctcgactacaaactcgtcgacgtccccgacctcggctacttcagcaccgaccggccgcacccgcgcggtgagctgctggtccgctccacgcagctattccccggctactacaaacgtcccgacgtcaccgccgaggtgttcgacgacgacggcttctaccgcacgggcgacatcgtcgccgaggtcggccccgatcaggtgcagtacctcgaccgccgcaacaacgtgctcaaactcgcccagggtgagttcgtcaccatctccaaactcgaggcggtcttcgccggcagcgccctggtccgccagatctacgtgtacggcaacagtgcgcgctcctacctgctggccgtcgtcgtgccgaccgacgatgcggtggcccggcacgacccggcatcgctcaagaccgcgatcagcgcctcgctgcagcaggccgcgaagaccgccggtctgcagtcctacgagctgccgcgtgacttcctcgtcgagactcaaccgttcacgctggagaacggactactgaccggcatccgcaagctggcgcgcccgaaactcaaggcgcgctacggcgatcggctcgaggcgctctacgtcgaactggtcgaaggacaggcaggcgaattgcgcaccctgcgccgggacggcgcgaagcgtccggtggccgagacggtcggccgcgccgcggccgcgctgctcggcgccgccgccgccgacgtgcgccccgacgcgcacttcaccgacctcggcggagactcgttgtcggcgttgaccttcggcaatctgctgcaggagatcttcggcgtcgacgtcccggtcggggtgatcgtcagcccggcggccgacctggcgtcgatcgcggcgtacatcgaggccgaacaggcctcgaccggtaagcggccgacctacgcgtcggtgcacgggcgcgacgccgaacaggtacacgcgcgcgacctcaccctggacaagttcatcgacgccgaaacactctccgctgcaacagaactgcccggcccgagcggtgaggtgcgcaccgtgctgctgaccggggccaccggattcctcggccgctacctggcgctggactggctcgaacggatggccctggtcgacggcaaggtcatctgcctggtccgcgcgaaggacgatgcggccgcccgcaaacgcctcgacgacaccttcgacagcggcgatccgaagctgctggcgcactaccgcaagctggccgccgaccacctcgaagtgctggccggcgacaagggtgaggcggatctcgggctgccgcatcctgtctggcagcgcctggccgacaccgtcgacctcatcgtcgacccggccgccctggtcaaccacgtactgccgtacagccagctgttcgggcccaacgcgctgggcactgccgagctgatccggcttgcgctcaccacccgcatcaaaccgttcacctacgtgtcgacgatcggcgtcggcgccggtatcgaaccgggccgtttcaccgaggacgacgacatccgggtgatcagcccgacgcgggccgtcgacaccgggtacgccaacggctacggcaacagcaagtgggccggtgaggtgttgttgcgcgaggcgcacgatctgtgcgggctccccgtggcggtgttccggtgcgacatgatcctggccgacaccacctacgccggccagctcaacctgccggacatgttcacccggatgatgctgagcctggtgaccacgggtatcgcgccgaaatcgttccacccactcgacgcaaagggccaccggcagagcgcccactacgacgggctgccggtcgagttcgtcgccgaatcgatctccgcgctgggagcgcaggcggtcgacgaggcgggaacgggtttcgccacctaccacgtgatgaacccccacgacgacgggatcggcctcgacgaattcgtcgactggctcgtcgaggcggggtatcgcatcgaccgcatcgactactacgcggcctggctgcagcggttcgaaaccgccctgcgggcgctgcccgagcgcactcggcagtactcactgctcccgctgctgcacaactaccagcggcctgcgcacccgatcaacggggcgatggccccgaccgaccggttccgcgctgcggtgcaggaggcaaagctcggcccggacaaggacattccccacgtcactccagcggtgatcgtcaagtacgccaccgacctggagctgctgggcctgatctag

SEQ ID NO: 48 - protein, 1174 aa, Mycobacterium sp.
MSTETREARLQQRIAHLFTTDPQFAAARPDPRISDAVDRDDTRLTAIVSAVMSGYADRPALGQRAAEFVTDPQTGRTTMELLPRFDTITYRELLDRVRALTNAWHADGVRPGDRVAILGFTGIDYTVVDLALIQLGAVAVPLQTSAAVEALRPIVAETEPMLIATGVDHVDAAAELALTGHRPSRVVVFDHREQVDDERDAVRAATARLGDAVPVETLAEVLRRGAHLPAVAPHVFDEADPLRLLIYTSGSAGAPKGAMYPESKVAGMWRASAKAAWNNDQTAIPSITLNFLPMSHVMGRGLLCGTLSTGGTAYFAARSDLSTLLEDLRLVRPTQLSFVPRIWDMLFQEFVGEVDRRVNDGADRPTAEADVLAVQRHELLGGRFVTAMTGSAPISLEMKTWVETLLDMHLVEGYGSTEAGAVFVDGHIQRPPVLDYKLVDVPDLGYFSTDRPHPRGELLVRSTQLFPGYYKRPDVTAEVFDDDGFYRTGDIVAEVGPDQVQYLDRRNNVLKLAQGEFVTISKLEAVFAGSALVRQIYVYGNSARSYLLAVVVPTDDAVARHDPASLKTAISASLQQAAKTAGLQSYELPRDFLVETQPFTLENGLLTGIRKLARPKLKARYGDRLEALYVELVEGQAGELRTLRRDGAKRPVAETVGRAAAALLGAAAADVRPDAHFTDLGGDSLSALTFGNLLQEIFGVDVPVGVIVSPAADLASIAAYIEAEQASTGKRPTYASVHGRDAEQVHARDLTLDKFIDAETLSAATELPGPSGEVRTVLLTGATGFLGRYLALDWLERMALVDGKVICLVRAKDDAAARKRLDDTFDSGDPKLLAHYRKLAADHLEVLAGDKGEADLGLPHPVWQRLADTVDLIVDPAALVNHVLPYSQLFGPNALGTAELIRLALTTRIKPFTYVSTIGVGAGIEPGRFTEDDDIRVISPTRAVDTGYANGYGNSKWAGEVLLREAHDLCGLPVAVFRCDMILADTTYAGQLNLPDMFTRMMLSLVTTGIAPKSFHPLDAKGHRQSAHYDGLPVEFVAESISALGAQAVDEAGTGFATYHVMNPHDDGIGLDEFVDWLVEAGYRIDRIDYYAAWLQRFETALRALPERTRQYSLLPLLHNYQRPAHPINGAMAPTDRFRAAVQEAKLGPDKDIPHVTPAVIVKYATDLELLGLI

SEQ ID NO: 49 - DNA, 3522 bp, Mycobacterium avium
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccatcacgtacggcgaagtggcgcagcgtgtttcggcgctgggccgcgccctgtccgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccagcaccggcgtggccgtccagacgctggccgagctgctggagcgcggcaaggacctgcccgccgtcggggagccgcccgccgacgaggactcgctggccctgctgatctacacctccgggtccaccggcgcccccaagggcgcgatgtacccgcagagcaacgtcggcaagatgtggcgccgcggcagcaagaactggttcggcgagagcgccgcgtcgatcaccctgaacttcatgccgatgagccacgtgatgggccgaagcatcctctacggcacgctgggcaacggcggcaccgcctacttcgccgcccgcagcgacctgtccaccctgctcgaggacctcgagctggtgcggcccaccgagctcaacttcgtcccgcggatctgggagacgctgtacggcgaattccagcgtcaggtcgagcggcggctctccgagtccggggacgccggcgaacgtcgcgccgtcgaggccgaggtgctggccgagcagcgccagtacctgctgggcgggcggttcaccttcgcgatgacgggctcggcgcccatctcgccggagctgcgcaactgggtcgagtcgctgctcgaaatgcacctgatggacggctacggctccaccgaggccggaatggtgttgttcgacggggagattcagcgcccgccggtgatcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccaacgagctggccgagctgcgccgcaacggtgcccaggcgccggtgctgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtgggcgtcatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgagacgctggccgccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaagctgctcgcgcactaccagcagctggccgccgatcacctggaggtcatcgccggcgacaagggcgaggccaatctgggcctgggccaagacgtttggcaacgactggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctacggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcatcggtctggacgagtacgtcgattggctggtggacgccggctattcgatcgagcggattgccgactactccgaatggctgcggcggttcgagacctcgctgcgggccctgccggaccggcagcgccagtactcgctgctgccgctgctgcacaactaccgcacgccggagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctga

SEQ ID NO: 50 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYGEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVGEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSESGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGIGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 51 - DNA, 3525 bp, Mycobacterium sp.
atgtccaccgagacccgtgaagcgcgcctgcagcagcgcatcgcgcatctgttcgccaccgacccgcagttcgccgccgcccggcccgacccccggatcagcgatgccgtcgaccgcgatgacgcgcggctgaccgccatcgtctccgccgtcatgtcggggtacgccgaccggccggcactcgggcagcgcgccgccgaattcgccaccgacccgcagaccggccgcaccacgatggagctgctcccccgcttcgacaccatcacctaccgggagctgctcgaccgcgtccgggcgctcaccaacgcgtggcacgccgacggggtgcgccccggcgaccgcgtcgcaatcctcggattcaccggcatcgactacaccgtcgtcgacctcgccctgatccagctcggcgcggtcgcggtgccgctgcagaccagcgccgccgtggaggcgctgcgcccgatcgtggccgagaccgaaccgatgctcatcgccaccggcgtcgatcatgtcgacgccgccgcggaactcgcactcaccggccaccgtccgtcccaggtggtggtcttcgaccaccgcgagcaggtcgacgacgaacgcgacgcggtgcgggccgcgacggcccggctgggagacgcggtgcccgtcgagacactcgccgaggtgttgcggcgtggcgcccatctgcccgccgtggcaccgcacgtgttcgacgaggccgatccactgcggctgctgatctacacctccggcagcaccggcgcccccaagggcgcgatgtatcccgagagcaaggtcgccggcatgtggcgcgcgtcggccaaggccgcctggaacaacgatcagacggcgattccgtcgatcaccctgaacttcctgccgatgagccacgtcatgggtcgcggcctgctgtgcggcacgctcagcaccggtggcaccgcgtatttcgccgcccgcagcgatctgtcgacgctgctcgaggacctgcgcctggtacggcccacccaactcagcttcgtgccacggatctgggacatgctcttccaggagttcgtcggcgaggtcgaccggcgggtgaacgacggtgcagaccgccccaccgcggaggccgacgtgctggccgaactgcgccaggagctgctcggtggccggttcgtcaccgcgatgaccggttcggcgcccatctcccccgagatgaagacatgggtggagaccctgctcgacatgcacctggtcgagggttacggctcgacggaggccggcgcggtgttcgtcgacggccacatccagcgcccgccggtgctcgactacaaactcgtcgacgtccccgacctcggctacttcagcaccgaccggccgcacccgcgcggtgagctgctggtccgctccacgcagctgttccccggctactacaagcgtcccgacgtcaccgccgaggtgttcgacgacgacggcttctaccgcacgggcgacatcgtcgccgagctcggccccgaccagctgcagtacctcgaccgccgcaacaacgtgctcaaactcgcccagggtgagttcgtcaccatctccaaactcgaggcggtcttcgccggcagcgccctcgtccgccagatcttcgtgtacggcaacagtgcgcgctcctacctgctggccgtcgtcgtgccgaccgacgatgcggtggcccggcacgacccggcatcgctcaagaccgcgatcagcgcctcgctgcagcaggccgcgaagaccgccggtctgcagtcctacgagctgccgcgtgacttcctcgtcgagactcaaccgttcacgctggagaacggactactgaccggcatccgcaagctggcccgcccgaaactcaaggcgcgctacggcgatcggctcgaggcgctctacgtcgaactggccgaaggacaggcaggcgaactgcgcaccctgcgccgggacggcgcgaagcgtccggtggccgagacggtcggccgcgccgcggccgcgctgctcggcgccgccgccgccgacgtgcgccccgacgcgcacttcaccgacctcggcggagactcgttgtcggcgttgaccttcggcaatctgctgcaggagatcttcggcgtcgacgtcccggtcggggtgatcgtcagcccggcggccgacctggcgtcgatcgcggcgtacatcgagaccgaacaggcctcgaccggcaagcggccgacctacgcgtcggtgcacgggcgcgacgccgaacaggtacgcgcgcgcgacctcaccctggacaagttcatcgacgccgaaacactctccgctgcaacagaactgcccgtcccgatcggtgaggtgcgcaccgtgctgctgaccggggccaccggattcctcggccgctacctggcgctggactggctcgaaaggatggccctggtcgacggcaaggtcatctgcctggtccgcgcgaaggacgatgcggccgcccgcaaacgcctcgacgacaccttcgacagcggcgatccgaagctgctggcgcactaccgcaagctggccgccgaccacctcgaagtgctggccggcgacaagggtgaggcggatctcgggctgccgcatcaggtctggcagcgactggccgacaccgtcgacctcatcgtcgacccggccgccctggtcaaccacgtactgccgtacagccagctgttcgggcccaacgcgctgggcactgccgagctgatccggcttgcgctcaccacccgcatcaaaccgttcacctacgtgtcgacgatcggcgtcggcgccggtatcgaaccgggccgtttcaccgaggacgacgacatccgggtgatcagcccgacgcgggccgtcgacaccgggtacgccaacggctacggcaacagcaagtgggccggtgaggtgttgttgcgcgaggcgcacgatctgtgcgggctccccgtggcggtgttccggtgcgacatgatcctggccgacaccacctacgccggccagctcaacctgccggacatgttcacccggatgatggtgagcctggtgaccacgggtatcgcgccgaagtcgttccacccactcgacgcaaagggccaccggcagcgcgcccactacgacgggctgccggtcgagttcgtcgccgaatcgatctccgcgctgggagcgcaggcggtcgacgaggcgggaacgggtttcgccacctaccacgtgatgaacccccacgacgacgggatcggcctcgacgaattcgtcgactggctcgtcgaggcggggtatcgcatcgaccgcatcgacgactacgcggcctggctgcaacggttcgaaaccgcgctgcgggcgctgcccgagcgcactcggcagtactcactgctcccgctgctgcacaactaccagcggcctgcgcacccgatcaacggggcgatggccccgaccgaccggttccgcgccgcggtgcaggaggcaaagctcggcccggacaaggacattccccacgtcacccccggggtgatcgtcaagtacgccaccgacctggaactgctggggctgatctag

SEQ ID NO: 52 - protein, 1174 aa, Mycobacterium sp.
MSTETREARLQQRIAHLFATDPQFAAARPDPRISDAVDRDDARLTAIVSAVMSGYADRPALGQRAAEFATDPQTGRTTMELLPRFDTITYRELLDRVRALTNAWHADGVRPGDRVAILGFTGIDYTVVDLALIQLGAVAVPLQTSAAVEALRPIVAETEPMLIATGVDHVDAAAELALTGHRPSQVVVFDHREQVDDERDAVRAATARLGDAVPVETLAEVLRRGAHLPAVAPHVFDEADPLRLLIYTSGSTGAPKGAMYPESKVAGMWRASAKAAWNNDQTAIPSITLNFLPMSHVMGRGLLCGTLSTGGTAYFAARSDLSTLLEDLRLVRPTQLSFVPRIWDMLFQEFVGEVDRRVNDGADRPTAEADVLAELRQELLGGRFVTAMTGSAPISPEMKTWVETLLDMHLVEGYGSTEAGAVFVDGHIQRPPVLDYKLVDVPDLGYFSTDRPHPRGELLVRSTQLFPGYYKRPDVTAEVFDDDGFYRTGDIVAELGPDQLQYLDRRNNVLKLAQGEFVTISKLEAVFAGSALVRQIFVYGNSARSYLLAVVVPTDDAVARHDPASLKTAISASLQQAAKTAGLQSYELPRDFLVETQPFTLENGLLTGIRKLARPKLKARYGDRLEALYVELAEGQAGELRTLRRDGAKRPVAETVGRAAAALLGAAAADVRPDAHFTDLGGDSLSALTFGNLLQEIFGVDVPVGVIVSPAADLASIAAYIETEQASTGKRPTYASVHGRDAEQVRARDLTLDKFIDAETLSAATELPVPIGEVRTVLLTGATGFLGRYLALDWLERMALVDGKVICLVRAKDDAAARKRLDDTFDSGDPKLLAHYRKLAADHLEVLAGDKGEADLGLPHQVWQRLADTVDLIVDPAALVNHVLPYSQLFGPNALGTAELIRLALTTRIKPFTYVSTIGVGAGIEPGRFTEDDDIRVISPTRAVDTGYANGYGNSKWAGEVLLREAHDLCGLPVAVFRCDMILADTTYAGQLNLPDMFTRMMVSLVTTGIAPKSFHPLDAKGHRQRAHYDGLPVEFVAESISALGAQAVDEAGTGFATYHVMNPHDDGIGLDEFVDWLVEAGYRIDRIDDYAAWLQRFETALRALPERTRQYSLLPLLHNYQRPAHPINGAMAPTDRFRAAVQEAKLGPDKDIPHVTPGVIVKYATDLELLGLI

SEQ ID NO: 53 - DNA, 288 bp, Mycobacterium leprae
atgagcaccgtggatggtgtgtgtgatgaagacatatattactattatgactgcatatattgcgctgccgatgttgccagcccgactgggtatttacccggaggactctttagcttggcgaagctgcttgttatacgtggggagaagcagtatgtcttcggcctgaatgactcgacgagtgtcggccccgggccgggcaacatgccctggctggacgacccaggcctgtctgctgtcattgcgagttccgtcgcagcggctgaattggctgctgcgcgatcctggtaa

SEQ ID NO: 54 - protein, 95 aa, Mycobacterium leprae
MSTVDGVCDEDIYYYYDCIYCAADVASPTGYLPGGLFSLAKLLVIRGEKQYVFGLNDSTSVGPGPGNMPWLDDPGLSAVIASSVAAAELAAARSW

SEQ ID NO: 55 - DNA, 3396 bp, Clavibacter michiganensis
atgagcactgagcagatgggcaccgagcagatggggagccagcacgaggacacgtcgatcgaggcgatcttcgcgcagcacgccgaccggacggcgctgcggcagcgatccgggccggacatcacggacatgggcttccgggagctgtgggaccgggcgggcgcgctggccgcggcgctcggcgagaccgtgtccgccggagaccgcatcgcggtgctcggcacggcgaccgcggacgccgtcacgctcgacctcgccgcgtggatcctcggcgcggtgagcgtgcccctccaggcgagcgcgcccgtcgcggccctgcgcgcgatcgtcgaggagacgacgccggtgtggatcgcggccaccgccgaccaggccgcgacggcccgggcggtcgccgaggcatcgggcgacggcatccggacgatgcggctcgacaccgacaccgacgcggacaccgacaccgacgccgccctgacgctcggcgcgctcgtcgcccgcggggccggcctgcgtcgccggagcccgtggcaccccgcacccggcgacgacccgctcgcgctcctgctctacacgtcgggcagcacgggcacgccgaagggcgcgatgtacacgcgctccatggtcgagcggatgtggcacgccctccggcccgaccccgccgcgcccgccgacgcatccacgaccgcggacgacggagacgccgcagccatcgtcgggtacgcgtacctccccatgagccacctcaccggccgctcctccctgctcgccacgctcggccgcggcggcacggtcgcgctcgcgacctcgaccgacctgtcgacgctcttcgacgacctgcggaccttcgccccgaccgagttcgtcttcgtgccgcgcgtcgcggagctggtgcggcaggagggcgaccgcgaggagcagcgccgactcaccgccggcagcacggaccgggacgcggtccgcgccgaggtccaggccgacctgcgcgcccgcgcgttcggcggacggatccaccgggcgatctgcaccagcgcaccgctgacgccggagctccgcacgtacatcgagggatgcctcgggctgacgctgcacgacctgtacgggtcgaccgaggccggcggcatcctccacgacggggtgatccagcagcctcccgtcaccgagcacaagctcgtcgacgtccccgagctcgggtaccgcaccaccgaccgcccgcacccgcggggcgagctgctcgtcaagagcgcctccgtgatcgccgggtacttccgccggccggacgtcaccgccgcggtgttcgacgaggacggcttctaccggaccggcgacgtcatggcgcagaccggacccggcacctacgagtacgtcgaccgtcggaacaacgtgatcaagctgtcgcagggcgagttcgtcgcggtggcatcgctcgaggcgacgtacggcgggacgcccgaggtgcaccagatcgcgctgcacggcgacagccggcacgcgttcctcgtcgcggtcgtcgtcccggcggaccccgcggcgtcggagcgcgacatcctcgcggccctccagcgcaccgcccgcgagcacggcctcgccccctacgaggtgccccgcggcgtgatcgtcgaaccggatccgttcacggtcgacggcggcatgctctccgacgccggcaagctcctgcgcctgcgcctcacgcagcggtacggcgagcgcctcgccgccctctacgacgcgctcgaggagcagcagagcggcaccctcgtcgccgcgctccgcgaacgcgccgacgacgagccgacggtcgacacggtggtgcgcgccgccctcctgctcctcggggccgaggtgtcccccgcgaccgccgccgctgcccggttctccgacctcggcggcgactcgctgtccgcgctgacgttctccgggatcctcgaggacgtcttcggcaccgaggtgcccgtcggcgtcctcaccgacccgaccaacgacctcgccgccgtcgccgcctacgtggagcgctccgcctccgacgaccggccgaccgtgacccgcgtgcacggcgccggcgcatccaccctccgcgtgggcgacctccggctcgaccggatgctcggcggcatcccgacgccggtcccccgggcctcggccgcccggccgggatcccgcacggtcctgctcaccggcgcgaacggctacctcggccggttcctggccatcgactggctcgagcgcctcgctgcgacgggcggcacgctggtgtgcatcgtgcgcggcgccgacgacgccgacgcccggcgccgcctcgaggccgcgttcgccgcggatcccgcgttcgcccggcgcttcgccgagctgtcgggctcgctcgaggtgctggccggagacgtcagcgagcaccgcctcggcctcgacgacgagcggtggatcgacctggccgcgcgggtcgacctcgtcgcgcacgcggctgccctcgtgaaccacgtcctcccgtactcggcgctgttcggtccgaacgtcgtcggcaccgccgaggcgatccgcctggcgatcgccgccggcagcgtgcccgtcaccttcgtctcgagcgtcgcggtcgcgggcggcgcgcggccgggcgcgaccgccgacgccgagccgtcggcgcccggcgcgctcgacgagcacgccgacatccgcgccacgatccccgagtgggccgtcggcgacgagtacgccaacgggtacggcgcgagcaagtgggcgagcgaggtgctgctccgcgaggcgcacgagcaccacggcgtccccgtggccgtgttccgctccgacatgatcctggcgcacccccgctggcgcggtcaggtgaacctccccgacgtcttcacccggctgatctggagcgtgctcaccaccggcctcgcccccgcatcgttcgtgaggcgcggccccgacggcgagcggcagcggtcgcactacgacgggctgccggccgacttcacggcggcggcgatcgacgggatcggcgcggcgctcaccgaggggcaccgcaccttcaacgtcgtgaacccccacgacgacggcgtctcgctcgacaccttcgtcgactggatccgcgaggacggccacgacatcgcgcgcgtggacgaccacgcggagtgggtcgaccggttccgcgcggcgctgggagcgctcccggacgcggaccgcgcccggtccgtcctgccgctgatgcacgcgttcgcctcgcccgaggagccgcacgccggctcggcgatcccggcggatgcgttcgccgaggccgtccgcgcggtgcgcccgctcgggtcgccggacatcccgtctctcgaccacgcgctcatcgccaaggtcgccgacgacctcgcgttcctggggctgctcgcgccggcgcgggcggcggctgcctga

SEQ ID NO: 56 - protein, 1131 aa, Clavibacter michiganensis
MSTEQMGTEQMGSQHEDTSIEAIFAQHADRTALRQRSGPDITDMGFRELWDRAGALAAALGETVSAGDRIAVLGTATADAVTLDLAAWILGAVSVPLQASAPVAALRAIVEETTPVWIAATADQAATARAVAEASGDGIRTMRLDTDTDADTDTDAALTLGALVARGAGLRRRSPWHPAPGDDPLALLLYTSGSTGTPKGAMYTRSMVERMWHALRPDPAAPADASTTADDGDAAAIVGYAYLPMSHLTGRSSLLATLGRGGTVALATSTDLSTLFDDLRTFAPTEFVFVPRVAELVRQEGDREEQRRLTAGSTDRDAVRAEVQADLRARAFGGRIHRAICTSAPLTPELRTYIEGCLGLTLHDLYGSTEAGGILHDGVIQQPPVTEHKLVDVPELGYRTTDRPHPRGELLVKSASVIAGYFRRPDVTAAVFDEDGFYRTGDVMAQTGPGTYEYVDRRNNVIKLSQGEFVAVASLEATYGGTPEVHQIALHGDSRHAFLVAVVVPADPAASERDILAALQRTAREHGLAPYEVPRGVIVEPDPFTVDGGMLSDAGKLLRLRLTQRYGERLAALYDALEEQQSGTLVAALRERADDEPTVDTVVRAALLLLGAEVSPATAAAARFSDLGGDSLSALTFSGILEDVFGTEVPVGVLTDPTNDLAAVAAYVERSASDDRPTVTRVHGAGASTLRVGDLRLDRMLGGIPTPVPRASAARPGSRTVLLTGANGYLGRFLAIDWLERLAATGGTLVCIVRGADDADARRRLEAAFAADPAFARRFAELSGSLEVLAGDVSEHRLGLDDERWIDLAARVDLVAHAAALVNHVLPYSALFGPNVVGTAEAIRLAIAAGSVPVTFVSSVAVAGGARPGATADAEPSAPGALDEHADIRATIPEWAVGDEYANGYGASKWASEVLLREAHEHHGVPVAVFRSDMILAHPRWRGQVNLPDVFTRLIWSVLTTGLAPASFVRRGPDGERQRSHYDGLPADFTAAAIDGIGAALTEGHRTFNVVNPHDDGVSLDTFVDWIREDGHDIARVDDHAEWVDRFRAALGALPDADRARSVLPLMHAFASPEEPHAGSAIPADAFAEAVRAVRPLGSPDIPSLDHALIAKVADDLAFLGLLAPARAAAA

SEQ ID NO: 57 - DNA, 3498 bp, Salinispora arenicola
gtgaccaccacggagcagaccctcaccgagcggctcatcgccgaggacgagcagatccggcgggcccaggtcagcgccgaagtctccgccgcgatgcgggtgccgggcatgtcgcaggcccagatcgtggccgccggattcaccggttacgccgaccgcgccgccctgggtgagcgcgcccgcgaagccgtcaccgacccggtcaccggccgcaccacccaccggcttctgccatggttcgacaccatcacctacggcgaggtccggtcgcgggtgctggcgatctccgccgcctggtggcacgacgtggacgctccactccgtcccggcgccttcgtcgtttcggtcggcgtccccagcgccgacctcgtgacggtcgagctcgcggtgctacacaccggcgcggtcagtgtgccactgcaggtcagctccaccgccgagcaactgcgcccgatcctcgacgaggccgccccgctcatcgtggccacgagcgtggaccggctcgctgtggtgaccgcggcgatgtcgggcaacgcgtcggtgcgccggatcatggtcctgaaccacgacgcagcgatcaccgcccaccgggatgccgtggacgccgcgcgatcggcgctcgccggcaccgcagtcgtcgtgcacacattgaccgaggtgttggaccgtggacggggcctgcccgcccctgagccctacgcggcgcccacgggggaggatcccctgtcgctgttgatctacacctcgggcagtaccggtacgcccaagggcgcaatgtttccggagagcatgacccgcgccaactgggtgcgtttcgaccccaagccgaccgacatggcggtcatccggctcaactacctgccgctgagccacaacgtcggccgcatcgtgctgttcgaggcgctcgcggtgggcggcatcgccttcttcaccgcacacagtgacctgtccacgctcctggaggacatggccctcgcccggcccaccgacctgttccttatcccgcggctgtgcgacatgctcgcccagcgccacgacagcgaactggcccgccgccgcatcaccaccgcggatcacgagggggtccgacaggtccacacccatctgcgcgaggctgtcctcggcggcagggtgacccgcgcgatgtcgctgtccgcgccgctgagcccacagctgcgtcggttcgtggagtcgtgtctcggcttcgcggtgcacgatgtcttcgggtcgaccgaggccggcgggctgctcgtcaacggccgggtgctgcgcccgccggtgctcgactatcgcttggtcgacgtccccgacctcggctacttcaccaccgaccgtccgtaccctcgcggggagctgctggtgcggaccgcgacgatcatccccggctactaccagcggcccgagctcaacgccgagctgttcaccgaggacggctactaccgcaccggcgacatcatggccgagtacggccccgaccacctcggctatgtcgaccgcaccacgagcgtgctgaagctgtcacagggcgagttcgtggccgtgtcacggttggaggaactgttcgccgcctccccgctgatccggcagatctacctgtacggcaacagcgagcggccgtacctgctcgccgtggtcgtgcccacggaggaggcgcacgccgccacccgggaacccgcggcgctcaaggcggtgctcggcgagtcgctgcaacgcatcgctcagcagcacggcctgcacccgtacgaggtgccgcgcgacctcctcatcgagaccaccccgttcagcaccgccaacggtctgctctccgacatccgtaagcccctgcgtccgaagctcaagacccggtacgctcctcgactcgaagcgctctacaccgagctcgccgagcgcgaggccgaccggatccgcacgctgcgcgacgccggttccgcgcaacccgtgctgcccgcgttgcgcgaggctgcccgggcgttcctcggccgcccaggcgcagcgctcgacgtgaacgaccgctttgtggacctcggcggcgactccctgtcggccctggccctgtcgaacctgctgagcgacatcttcgaggtccgcgtcccggtcggcatcatgatcagcgcgaccggcacgctcggttccgtggcggcctggatcgaggccgagcgtgccaccgccggagcgggtatcggccgcgcgacgcccacctccgtgcacggtgcgaacctcacccaggtacacgccgatgacctgaccctcggcacgttcctcgacgtgacgaccctcgccgccgctgcctgcctgccccgggcgccgctgtccgacccgcgcgtggtgctgctgacgggtgcgaccggctatctgggccggttcctggccctcgagtggctggaccgcctttcccgtagcggcgggacgctcgtgtgcgtggtgcgcgccgccgacgatgcggaagccgcgcgccgcctggaaagtgtctatggctccagcgaccccgagttgctggagcgcttccgttcactcgccggccacgtgcgcgtgttggccggcgatgttgccgaagccaggttcggcctgccggccggggtgtggcaggaactggccgaaacggtggacctgatcgtgcactccgcggcactggtcaaccacgttctcccgtacgaacagctgttcgggcccaacgtggcgggaacggcggaactggtgcgcctcgccgtcagcgtacgggtgaagggaattgcctttctctccaccgttgccgtgatcacctcgcagaccacgacacccgacgaggacgcggacatccggcaggcgagcccgcaccgggtgctcgacgacagctacgcgaacggctacgcggccagcaagtgggcaggtgaggtgctcctgcgacgcgcccacgaggagtacggcgtgccggtcagcgtgttccgctcggacgtcatcctggcccactcccgctacgccgggcagctcaacgtcccggatatgttcacgcgcctgctcctgagcatcctggcgaccggtattgccccagcgtcgttttatcgcaccggcccggacggcgaacgccagccggcgcactacgacggtctcccggtcgacttcaccgcggcggccgtagccgcggtgggtgtcaccgagggacaccgcaccttcaacgtactgaatccacacgaggacggcatcgggctggatacctttgtggactggctcgtggcagccggacacccggtgcagcgcatcgcggaccacgacgagtgggtgacccgcttcgccacggccatgcgtgggctgcctgaacgccagcgccgcagctcgatcctgccgctcctacacgcctttgccgagcccgctccgccgaccttcggatccagactgccgacggaccggtttcgcgccgccgtgaaagccgccaacgtggtccccggcaacgagatcccgcacctcgatgcggccctcgtcaccaagtacgccgacgacctcaggctgctcgaccttctctga

SEQ ID NO: 58 - protein, 1165 aa, Salinispora arenicola
VTTTEQTLTERLIAEDEQIRRAQVSAEVSAAMRVPGMSQAQIVAAGFTGYADRAALGERAREAVTDPVTGRTTHRLLPWFDTITYGEVRSRVLAISAAWWHDVDAPLRPGAFVVSVGVPSADLVTVELAVLHTGAVSVPLQVSSTAEQLRPILDEAAPLIVATSVDRLAVVTAAMSGNASVRRIMVLNHDAAITAHRDAVDAARSALAGTAVVVHTLTEVLDRGRGLPAPEPYAAPTGEDPLSLLIYTSGSTGTPKGAMFPESMTRANWVRFDPKPTDMAVIRLNYLPLSHNVGRIVLFEALAVGGIAFFTAHSDLSTLLEDMALARPTDLFLIPRLCDMLAQRHDSELARRRITTADHEGVRQVHTHLREAVLGGRVTRAMSLSAPLSPQLRRFVESCLGFAVHDVFGSTEAGGLLVNGRVLRPPVLDYRLVDVPDLGYFTTDRPYPRGELLVRTATIIPGYYQRPELNAELFTEDGYYRTGDIMAEYGPDHLGYVDRTTSVLKLSQGEFVAVSRLEELFAASPLIRQIYLYGNSERPYLLAVVVPTEEAHAATREPAALKAVLGESLQRIAQQHGLHPYEVPRDLLIETTPFSTANGLLSDIRKPLRPKLKTRYAPRLEALYTELAEREADRIRTLRDAGSAQPVLPALREAARAFLGRPGAALDVNDRFVDLGGDSLSALALSNLLSDIFEVRVPVGIMISATGTLGSVAAWIEAERATAGAGIGRATPTSVHGANLTQVHADDLTLGTFLDVTTLAAAACLPRAPLSDPRVVLLTGATGYLGRFLALEWLDRLSRSGGTLVCVVRAADDAEAARRLESVYGSSDPELLERFRSLAGHVRVLAGDVAEARFGLPAGVWQELAETVDLIVHSAALVNHVLPYEQLFGPNVAGTAELVRLAVSVRVKGIAFLSTVAVITSQTTTPDEDADIRQASPHRVLDDSYANGYAASKWAGEVLLRRAHEEYGVPVSVFRSDVILAHSRYAGQLNVPDMFTRLLLSILATGIAPASFYRTGPDGERQPAHYDGLPVDFTAAAVAAVGVTEGHRTFNVLNPHEDGIGLDTFVDWLVAAGHPVQRIADHDEWVTRFATAMRGLPERQRRSSILPLLHAFAEPAPPTFGSRLPTDRFRAAVKAANVVPGNEIPHLDAALVTKYADDLRLLDLL

SEQ ID NO: 59 - DNA, 3555 bp, Mycobacterium abscessus
atgaccgtgaccaacgaaaccaacccacagcaggagcagctatcccgccgtattgaaagtctgcgcgaaagcgatccgcagttccgggcggcccagcccgacccggcggtcgccgaacaggtgctgcgcccgggcctgcatctttctgaagccattgcggcgttgatgactggatacgctgagcgcccggcgctcggtgagcgcgcacgcgagttggtcaccgaccaggatggccgcaccacgctgcgcctgttgccacgcttcgacaccaccacatacggcgaattatggtcccgcacaacatcagtcgccgctgcatggcaccacgacgccgcccacccggttaaggccggcgatctggtggccaccctgggattcaccagcatcgactacaccgtgctggatctggcgatcatgatcctcggtggcgtggcggttccgctacagaccagcgccccggcttcgcagtggacgaccattctggccgaagcggaacccaacactcttgcggtaagcatcgaattgatcggcgctgcaatggaatctgtgcgggccacgccttccatcaagcaggtcgtcgtgttcgactacacccccgaggtcgatgatcaacgggaggcattcgaggcagcaagcacacaactcgccggcaccggcatcgccattgagaccctcgatgccgtcatcgcccgcggcgccgcacttccggccgcaccgctctacgcaccatcggccggcgacgatccgctggcgctgctcatctacacctccggcagcaccggggctccaaagggcgccatgcacagcgaaaacatcgtgcgccgctggtggattcgtgaggacgtcatggccggcaccgagaacctgcccatgatcgggctgaacttcatgccgatgagtcacatcatgggacgcggcaccctcacctccaccctgtctaccggtggaaccggatacttcgcggcgtccagtgacatgtcaacgctcttcgaggacatggagctgatccgcccgacggccctggccttggttccacgcgtgtgcgacatggtgttccagcgattccagaccgaggtggaccggcgtctggcgagcagcgacaccgccagtgccgaggccgttgcggccgaggtcaaggccgatatccgtgacaacctcttcggtggccgcgtatcggcggtcatggtcggttctgctccgttgtccgaggagctgggtgagttcatcgaatcctgcttcgagctgaatctgaccgatggctacggctccaccgaagccggcatggtgttccgcgacggcatcgtgcaacgcccgccggtcattgactacaagctggttgacgtgcccgaactgggctacttctccaccgacaagccgcacccgcgcggtgagctgctgctgaagaccgacggcatgttcctcgggtactacaaacgccccgaggtgactgccggcgtcttcgacgcggacggtttttacatgaccggcgacatcgtcgccgagctggcccacgacaacatcgagatcatcgatcgccgcaacaacgtgctcaaactctcacagggagagtttgtcgcggtcgccaccttggaggccgagtacgccaatagccctgtggtgcaccagatctacgtctacggcagcagcgaacggtcctacctgctagcagtcgtggtgccgacgccggaggccgtggccgccgccaagggcgacgcggcggcactcaagacgaccatcgcggactcgctgcaggacattgccaaggagatccagctgcagtcctacgaagtcccccgtgacttcatcatcgaaccgcagccattcacccagggcaacggcctgctgacgggtatcgccaagctggcgcgtccgaacctgaaggcgcactatggaccgcggctggagcagatgtacgccgaaatcgccgagcagcaggctgccgagcttcgggcgttgcacggagtggacccagacaagcccgcgctggaaacggtcctcaaggcggcgcaggccctgctcggcgtctcgtcggccgaactggccgcggacgcgcatttcaccgatctaggtggcgattcgctgtccgcactgtccttctcggatctgctgcgcgatatcttcgcggtcgaagtaccggtcggagtcatcgtcagtgccgcaaacgatctcagcggtgttgcgaaatttgttgatgaacaacgctattcgggcgggacgcggccgaccgcggagacggtgcacggcgccgggcatacggagatccgggccgcggacctgaccctggataagttcatcgacgaggccaccctgcatgcggcaccgtcgcttccgaaggccgtcgggatcccacacaccgtcctgctcaccgggtccaacggctacctgggccactacctggcactggaatggcttgagcgcctggacaagacagaaggcaagctgatcgccatcgtccgcggtaagaatgccgaggccgcctaccgccgcctcgaggaagccttcgacaccggcgacacgcagctgttggcgcacttccggtcgctggccgacaagcacctcgaagtactggccggcgatatcggcgaccccaaccttggcctggatgccgacacctggcagcgcctggccgacaccgtcgacgtcatcgtgcaccccgccgccctggtcaaccacgtactgccctacagccagctgttcggaccgaatgtcgtcggcaccgccgagatcatcaagctggccatcactaccaagatcaagccggtcacctacctgtccacggtcgcggtcgcggcatatgtcgatccgacgacattcgacgaagagtccgatatccggctcatcagcgcggtgcgtcccgtggacgagctgtacgcgaacggctacggcaacagcaagtgggccggcgaggtactgctgcgcgaagcccacgatctgtgcggactacccgtcgcggtcttccgctccgacatgatcttggcccacagccgctacaccggacagctcaacgtgcccgaccagttcacccgactaatcctcagcctcatcgccaccggaatcgcacccggctccttctaccaagcacacgccaccggcgaacgcccactcgcccactacgacgggctacccggtgacttcaccgccgaggcgatcaccacgttgggcacccaggtggtcgacagctacgagacctacgactgcgtgaacccgcatgcagacggagtctcgctggacaacttcgtcgactggctcatcgaagccggctaccccatcgcacgcatcgacaactacaccgaatggttcacccgcttcgacaccgccatccgaagcctccccgaaaaacagaaacaacactccctactaccactgctccacgcattcgaacagccgtccgccgccgagaaccacggcgtcgtcccggcaaagcgtttccagcacgctgtgcaggccgccggaatcggtccggccgggcaagacggcactaccgacattccccacctgtcgcggcggctgatcgtgaaatacgccaaggacctcgaacagctcggactcctatga

SEQ ID NO: 60 - protein, 1184 aa, Mycobacterium abscessus
MTVTNETNPQQEQLSRRIESLRESDPQFRAAQPDPAVAEQVLRPGLHLSEAIAALMTGYAERPALGERARELVTDQDGRTTLRLLPRFDTTTYGELWSRTTSVAAAWHHDAAHPVKAGDLVATLGFTSIDYTVLDLAIMILGGVAVPLQTSAPASQWTTILAEAEPNTLAVSIELIGAAMESVRATPSIKQVVVFDYTPEVDDQREAFEAASTQLAGTGIAIETLDAVIARGAALPAAPLYAPSAGDDPLALLIYTSGSTGAPKGAMHSENIVRRWWIREDVMAGTENLPMIGLNFMPMSHIMGRGTLTSTLSTGGTGYFAASSDMSTLFEDMELIRPTALALVPRVCDMVFQRFQTEVDRRLASSDTASAEAVAAEVKADIRDNLFGGRVSAVMVGSAPLSEELGEFIESCFELNLTDGYGSTEAGMVFRDGIVQRPPVIDYKLVDVPELGYFSTDKPHPRGELLLKTDGMFLGYYKRPEVTAGVFDADGFYMTGDIVAELAHDNIEIIDRRNNVLKLSQGEFVAVATLEAEYANSPVVHQIYVYGSSERSYLLAVVVPTPEAVAAAKGDAAALKTTIADSLQDIAKEIQLQSYEVPRDFIIEPQPFTQGNGLLTGIAKLARPNLKAHYGPRLEQMYAEIAEQQAAELRALHGVDPDKPALETVLKAAQALLGVSSAELAADAHFTDLGGDSLSALSFSDLLRDIFAVEVPVGVIVSAANDLSGVAKFVDEQRYSGGTRPTAETVHGAGHTEIRAADLTLDKFIDEATLHAAPSLPKAVGIPHTVLLTGSNGYLGHYLALEWLERLDKTEGKLIAIVRGKNAEAAYRRLEEAFDTGDTQLLAHFRSLADKHLEVLAGDIGDPNLGLDADTWQRLADTVDVIVHPAALVNHVLPYSQLFGPNVVGTAEIIKLAITTKIKPVTYLSTVAVAAYVDPTTFDEESDIRLISAVRPVDELYANGYGNSKWAGEVLLREAHDLCGLPVAVFRSDMILAHSRYTGQLNVPDQFTRLILSLIATGIAPGSFYQAHATGERPLAHYDGLPGDFTAEAITTLGTQVVDSYETYDCVNPHADGVSLDNFVDWLIEAGYPIARIDNYTEWFTRFDTAIRSLPEKQKQHSLLPLLHAFEQPSAAENHGVVPAKRFQHAVQAAGIGPAGQDGTTDIPHLSRRLIVKYAKDLEQLGLL

SEQ ID NO: 61 - DNA, 3552 bp, Mycobacterium abscessus
atgacgatcgacgccaccgcggacaacaccaaggaagcacgtcgtcagcggttaggcgaccgcatcaggcgcctattcaccgacgatgagcagttccgtgccgccaagcccgataccgcggttgataccgccgtcgcccagcctggtctgcgtctcgcccaggtggtcgccacgatcatgaacgggtacgcggaccgtccggcgctcgggcaccgagtccaggagctcgtcgccgacgccgccggccgttcgacgctgcgcccgttgcccgagttcgagacggtcacctacggagagctgtggggcatggcccgcgcgttggcctccacctggtaccacgatcccgccgctccggtacgggccggggacttcgtcgcgatgctcggcttcaccagcgtggactacaccgctgtcgacttggcatgcatccaccttggcgcggtggcggttccattgcagaccagcgcatcggcatccaactggaccgcgatcctggccgaatcggaacctgccgtcctggcggtaagcgccgagttgctcgatacggcaatggaatcggtgctcgccacgccgtcgctgcggcacatcaccgtctttgactatcatcccggtgtcgacgtgcagcgcgaaagtctcgaatccgcacagcaccggatcgccgaggccggcctgccgatttcggtagacccgatacccctggcgatcgggcacgggcgcgccttgccggatgcgccgttgttcaccgcagaggagggtaccgacccgctggccctggtgatctacacctcgggaagcaccggaactcccaagggcgccacctatagcgaaaagatggtcgccaagccctggctgcgggccgacacgttgagctctaaggccgaaattcctttgatcaacctgaatttcatgccaatgagccatgtgatgggacgcggtagtctggtcactgccctggcctgcggcggcctggcttactttgccgcgtccagcgacatgtccacgctgttcgaagacatcacgcttacgcgccccaccgtggtgacactcgtgccccgtgtgtgcgacatgcttttccagcgctaccgcaacgaggttgaacgccgtaccgggcttgatccggcggccgacctggccacccttgatgccgatgtcaagaccgatatccgcgaaaacctgttcggcgggcgtgttctgacaatcgtgtgcggctctgccccactgtccgaggaactggccgccttcatcgaatcctgcctcgatgcccgtatcaccgatggctacggctccaccgaggcgggcgtcatcgtgcgcaacggccgcattcagcgcccgcccgtcatcgactacaagctggtcgacgtgcctgagctcggttacttctccaccgacaagccgcacccgcgcggcgagctgctcgtgaaagccgaatcggtgttcggcggctacttcaaacgccccgacgtcaccgccgacgtattcgatcccgacgggtactacaagaccggggacatcgtcgccgagctcgagcccgacaagatccagatcgtggaccggcgcaacaacgtgatcaagctgtcccagggtgagttcgtggcgatcgccaacctggaagccgagttcgccaatagtccactggtgcatcagatctgcgtctacggcagcagcgagcggtcgtatctgctagcggtggtcgtgccgaccgctgaggcatatgaacaaagcggtggagatgaggatctactcaaacgcctgatcgcggactctctcgcgcaggttgcccgcgaggcccaactgcagtcctacgaggtaccgcgcgacttcctgctggagaccgaaccgttcaccgctgccaacggcctactgaccggcatcgcgaagctggcccgaccgaagctccatgagaagtacggcgcccgcctggagcagctgtactccgatatcgccgccgcccaggcgcttgagctgcaagcactgcactctgccggacatgaggacaagcctgtcctggataccgtgcaacgcgcggtcacggcgttgttggggctgtcggcggccgaggtgagcccagacgcgcatttcatcgaccttggtggcgattcactatccgcccttgccttctcggacctgctgcgcgatatcttcactgtggaggttccggttggcgatatcgtcagcgccgccaacgatctgaccgctatcgcacgcatcgtggaaagacaccgggaagcagacggtcattcggtaactcccaccgccgaatccgtgcacggtgccgggcaccgcgagatccgggccgcggacctgacgctggacaagttcatcgacgcggacaccctgcgcgcggccccggcactgtccacattcaccggcaccccgcacacggtgctgctcaccggcgccaacggctacctggggcggttcctggccctggaatggcttgagcgcctggacaagacagacggcaagctgatcgccatcgtccgcggtaagaatgccgaggccgcctaccgccgcctggaggaagccttcgacaccggcgacacgcagctgttggcgcacttccggtcgctggccgacaagcacctcgaagtactggccggcgatatcggcgaccccaaccttggcctggatgccgacacctggcagcgcctggccgagaccgtcgacgtcatcgtgcaccccgccgccctggtcaaccacgtactgccctacagccagctgttcggacccaatgtcgttggcaccgccgaaatcatcaagctggcactcaccaccaagatcaagcccatcacctacctctccacagtggccgtggcaatctcggtggaccccaaggtattcgatgaagactccgacatccgcacgatcagcgcggtacgaccaatcaacgacggctacgccaacggatacggcaacgcgaaatgggctggcgaggtactgctgcgcgaagcccacgacctgtgcggactacccgtcgcggtcttccgctccgacatgatcttggcccacagccgctacaccggacagctcaacgtgcccgaccagttcacccgactaatcctcagcctcatcgccaccggagtcgcacccggctccttctaccaagcacacgccaccggcgaacgcccactcgcccactacgacggcctgcctgcggatttcacggcatcggccatcaccgccctcgggcccatcgaggagttccacacctacgattcggtgaacccgcatgccgatgggatctcgctggacaacttcgtcgactggctcatcgaagccggctaccccatcgcacgcatcgacaactacaccgaatggttcacccgcttcgacaccgccatccgaagcctccccgaaaaacagaaacaacactccctactaccactactacacgcgtacaggcatccacaacacccacacaacggcgcattcctgcccgcgatcaggttcagtgaaggcgtccaggcccatctgaacgccgacatcccgcacctcacgcgggaactcatcgcgaaatacgcggccgacctgaagcagctcgggttactctag

SEQ ID NO: 62 - protein, 1183 aa, Mycobacterium abscessus
MTIDATADNTKEARRQRLGDRIRRLFTDDEQFRAAKPDTAVDTAVAQPGLRLAQVVATIMNGYADRPALGHRVQELVADAAGRSTLRPLPEFETVTYGELWGMARALASTWYHDPAAPVRAGDFVAMLGFTSVDYTAVDLACIHLGAVAVPLQTSASASNWTAILAESEPAVLAVSAELLDTAMESVLATPSLRHITVFDYHPGVDVQRESLESAQHRIAEAGLPISVDPIPLAIGHGRALPDAPLFTAEEGTDPLALVIYTSGSTGTPKGATYSEKMVAKPWLRADTLSSKAEIPLINLNFMPMSHVMGRGSLVTALACGGLAYFAASSDMSTLFEDITLTRPTVVTLVPRVCDMLFQRYRNEVERRTGLDPAADLATLDADVKTDIRENLFGGRVLTIVCGSAPLSEELAAFIESCLDARITDGYGSTEAGVIVRNGRIQRPPVIDYKLVDVPELGYFSTDKPHPRGELLVKAESVFGGYFKRPDVTADVFDPDGYYKTGDIVAELEPDKIQIVDRRNNVIKLSQGEFVAIANLEAEFANSPLVHQICVYGSSERSYLLAVVVPTAEAYEQSGGDEDLLKRLIADSLAQVAREAQLQSYEVPRDFLLETEPFTAANGLLTGIAKLARPKLHEKYGARLEQLYSDIAAAQALELQALHSAGHEDKPVLDTVQRAVTALLGLSAAEVSPDAHFIDLGGDSLSALAFSDLLRDIFTVEVPVGDIVSAANDLTAIARIVERHREADGHSVTPTAESVHGAGHREIRAADLTLDKFIDADTLRAAPALSTFTGTPHTVLLTGANGYLGRFLALEWLERLDKTDGKLIAIVRGKNAEAAYRRLEEAFDTGDTQLLAHFRSLADKHLEVLAGDIGDPNLGLDADTWQRLAETVDVIVHPAALVNHVLPYSQLFGPNVVGTAEIIKLALTTKIKPITYLSTVAVAISVDPKVFDEDSDIRTISAVRPINDGYANGYGNAKWAGEVLLREAHDLCGLPVAVFRSDMILAHSRYTGQLNVPDQFTRLILSLIATGVAPGSFYQAHATGERPLAHYDGLPADFTASAITALGPIEEFHTYDSVNPHADGISLDNFVDWLIEAGYPIARIDNYTEWFTRFDTAIRSLPEKQKQHSLLPLLHAYRHPQHPHNGAFLPAIRFSEGVQAHLNADIPHLTRELIAKYAADLKQLGLL

SEQ ID NO: 63 - DNA, 3492 bp, Mycobacterium abscessus
atgacggctggtgcggcggctcgcgttgccaaactgttcgagtccgatccccaattccgggcagccatgccggatccagcggtgatggactcgctgctggcgcccggcctgcgtttatcccaggtactccacgcgttgctcagcggttacgcggagcgcccggtgatgggtttccggtcccgcgagtcggtggtcgacaccgccaccggccgcacggtcgaccggctgctccctgcctttgaaaccatcacctatgggcaactcctggaagacatctcggccatcctcgcggagtggcagcatggcgacattcccatgggcgccggcgacttcatcgccaccatcggcttctccagtcccgactacgtcaccctggatctggccaccctcatgaatggttcggtctcgatcccactgcagcacaacacatctgtggcgcagctgcggatgatgctggaggagaccagcccacgcctggtggcggcgagcgcggactgcctggatctcgcggtcgaggcagctgtcgggcttaccgatctgcgacgggttgtggtgttcgattaccgcgccgagaccgacgatcatcgcgaaaaactggccacggcaagagaacgcttgcacgcggccggtatggacgttgtagtcgaaccgctcgcagaggtgatcgggagaggacgagacctacccgaacccgtgctgtacacggccggggacgatcagcgcacggccctgatcatgtacacctccggtagcaccggcgcgcccaagggggcgatgttcaccgagtggacggtgacccgcttctggtcctcgggcgccgcccccaaccgggacaccccgatcatcaacgtgaacttcctgccgctcaaccaccttgcgggccgggtaggactgctgacggccttcattcccggcggcacatgctacttcgtccccgagagcgatctgtccaccctgttcgaggactggcagctggcacggcccacccatatgggtgtggttccccgtgtcgtcgacatgctcttccagcactaccaaacgcgagtggacgcactgatggccgggggaaccgacgtcgacaccgccgatcggctagccaaaaccgaactgcgcgaagatgtcctgggcgggcgtgtggtcgccggcatgctcgccaccgcgccgttgtcccccgagatgaaggctttcctggagtcctcattggactttcatctgcttgatctgtacggcctgaccgaggtcggcggcgtgttccgagacggcaagatttcccggccgccggtgctcgactacaagctcgtcgatgttcctgagctcgggtactacaccaccgacaagccccatccgcgtggcgaattgctggtcaagagtgccaccgcaacgcccggctactacaagcgtcccgacgtcaccgccgaggtgttcgacgccgatggctactaccgcacgggcgatgtcatggcggaggtcgcgccggaccaattggtgtacgtggacaggcgcaataacgtcatcaagctcgcccagggcgagttcgtcgcggtcgccaatttggaaacggtctatgtgggtgcgccgctggtgcgccagatcttcgtctacggcaacagcgaacgcgcatacctcctcgccgttgtggtgcccaccgaggaagccctgcgggcacacccggaccccgtcgaactgaagaattcgatccgggagtcactgcagcggaccgcccgctccaaccacctgcattcctacgagctgcccgccgacttcattatcgaaaccactccattcacgatcgagagtgggatgcttgcggctgtcggtaagccgatacgtcccaagatgatcgagcactacggcgaccggctcgagcagctctacgtcgacctcgccgaggcacgcgtccaggaactgcggcagctccgcgatacggcgcaacaacgcccggtcctcgataccgtcaccgaggccgcccaggccctcctcggcatgtctgcggacgccgtccgtcccgaccaccacttcatcgacctcggcggagattcgctgtccgcgttgacattctccaatcttcttcgagacctcttcgacgtcgaggttccggtcggtgtgatcaccggcccggcggccgatctgcgcaagctcgccgcttacatccagcacgaacgggagcacagcaccgcgaccgctgccagcgtgcacgggctcgacaccaccgtcatcagcgccaccgaactgacactcgacaagttcatcgacgccgagacactccacaacgcttcgcaactcgacgtgccggcgggcgcggtagctaccgttctgctcaccggcgccaacggatatctcggaagattcctctgcctggagtggctgcaacggctgtcccagacaggtggacaactgatctgcctggtccgcggcgacaacgccgatcaagccctcgcgcgcctcgttgccgcctacggcgacaccgatcgcacactgctcgaggagttccacaccctggctcgacggcacctgcgcgtgatcgccgccgatatcgctcagccgcgcttcggcgtggatgacgccacctgggagcagctggcccgcgatgtcgacaagatcgtgcatccggccgcgctggtcaaccacgtgctgccctacaaccagctgttcggccccaatgtgtttggcacggcggaggttatccggctggccctgaccacccggatcaagccggtgacctatctgtcgacgatggccgtggccatgaccgtgcccgatttcgacgaggacggggacatccgcacggtgagtcccacccggcatatcgaccccggctacgccaacgggtacgccaacagcaaatgggccggcgaggtgctgctgcgggaggcacacgacatatgcggcctgccggtcagcgtgttccggtccgacatgatcctgacgcaccgccgttacagcggacaactcaacgtcaccgacgccttcacccgcatgctgctgagcctggtgctcaccggcatcgcgccgcgaagcttttaccaaggcgatggcagcggtgcccgcccacgcgctcactacgaggggctgccggtcgatttcgtcaccgaagccattaccagcctcggcctgtcctcgtccgagggatttcgctcgtacgacgtcatgaatcctcacgatgacggcatttctgtggacacctttgtcgactggctcatggaagatgggcattccatcgacatcatcgacaactacgacgaatggctgtcccgtttcgagacggcattgcgaggtctgcccgacgagcagcggcgcgcctcagtacttccgctcctcgatgcgtatcggataccgggcaacccgcgccgtgctgccgccacgcccaatcatgtattccggaaagccgtacaggagaacaacatcggaggtgacggcgccgatattccgcaaatcgatcgtgcgctgatcgccaaatacatcgccgatctacgagcacacaggctgctgtga

SEQ ID NO: 64 - protein, 1163 aa, Mycobacterium abscessus
MTAGAAARVAKLFESDPQFRAAMPDPAVMDSLLAPGLRLSQVLHALLSGYAERPVMGFRSRESVVDTATGRTVDRLLPAFETITYGQLLEDISAILAEWQHGDIPMGAGDFIATIGFSSPDYVTLDLATLMNGSVSIPLQHNTSVAQLRMMLEETSPRLVAASADCLDLAVEAAVGLTDLRRVVVFDYRAETDDHREKLATARERLHAAGMDVVVEPLAEVIGRGRDLPEPVLYTAGDDQRTALIMYTSGSTGAPKGAMFTEWTVTRFWSSGAAPNRDTPIINVNFLPLNHLAGRVGLLTAFIPGGTCYFVPESDLSTLFEDWQLARPTHMGVVPRVVDMLFQHYQTRVDALMAGGTDVDTADRLAKTELREDVLGGRVVAGMLATAPLSPEMKAFLESSLDFHLLDLYGLTEVGGVFRDGKISRPPVLDYKLVDVPELGYYTTDKPHPRGELLVKSATATPGYYKRPDVTAEVFDADGYYRTGDVMAEVAPDQLVYVDRRNNVIKLAQGEFVAVANLETVYVGAPLVRQIFVYGNSERAYLLAVVVPTEEALRAHPDPVELKNSIRESLQRTARSNHLHSYELPADFIIETTPFTIESGMLAAVGKPIRPKMIEHYGDRLEQLYVDLAEARVQELRQLRDTAQQRPVLDTVTEAAQALLGMSADAVRPDHHFIDLGGDSLSALTFSNLLRDLFDVEVPVGVITGPAADLRKLAAYIQHEREHSTATAASVHGLDTTVISATELTLDKFIDAETLHNASQLDVPAGAVATVLLTGANGYLGRFLCLEWLQRLSQTGGQLICLVRGDNADQALARLVAAYGDTDRTLLEEFHTLARRHLRVIAADIAQPRFGVDDATWEQLARDVDKIVHPAALVNHVLPYNQLFGPNVFGTAEVIRLALTTRIKPVTYLSTMAVAMTVPDFDEDGDIRTVSPTRHIDPGYANGYANSKWAGEVLLREAHDICGLPVSVFRSDMILTHRRYSGQLNVTDAFTRMLLSLVLTGIAPRSFYQGDGSGARPRAHYEGLPVDFVTEAITSLGLSSSEGFRSYDVMNPHDDGISVDTFVDWLMEDGHSIDIIDNYDEWLSRFETALRGLPDEQRRASVLPLLDAYRIPGNPRRAAATPNHVFRKAVQENNIGGDGADIPQIDRALIAKYIADLRAHRLL

SEQ ID NO: 65 - DNA, 3537 bp, Mycobacterium abscessus
atgactgaaacgatctccacagcggctgtccccactacggatctcgaagagcaggtgaagcgacgcatcgagcaggtcgtgtccaacgatccgcagctggcggcgcttctcccggaagattcggtcaccgaggcggtcaacgagcccgatctaccgctggtcgaggtgatcaggcgactgctggagggctacggtgaccgcccggcactcggccagcgcgccttcgagttcgtcaccggggacgacggtgcgaccgtgatcgcgctgaagcccgaatacaccaccgtctcctaccgcgagttgtgggaacgtgccgaggctatcgctgccgcgtggcacgagcagggcatccgtgacggcgacttcgtcgctcagttgggtttcaccagcacggacttcgcgtcgctcgacgtcgcgggattgcgtctgggcaccgtctcggtgcccctgcagacgggcgcgtcgctgcagcagcgcaacgcgattctcgaagagacccggcccgcagtctttgccgcgagtatcgaataccttgatgccgccgtcgattcggtgcttgcgaccccctcggtgcgactcctctcggttttcgactatcacgcggaggtcgacagccagcgcgaagcgctggaggctgtgcgggcccggcttgagagtgccggccggacgatcgtcgtcgaggccctggcggaggctctcgcgcgggggcgggacctgcccgccgcgccgctgcccagtgcagatcccgatgccttgcgtctgctcatctacacctccggcagcaccggtacccccaagggcgccatgtatccgcaatggctggtcgccaacttgtggcagaagaagtggctcaccgacgatgtgattccgtccataggcgtgaacttcatgcccatgagccacctggcgggtcgcctcactctcatgggcaccctttccggtggcggaaccgcctactacatcgcttcgagcgatctttcgactttcttcgaggacatcgcgctcatccgcccctccgaagtgctcttcgtgccgcgtgtggtggagatggtgttccagcgttttcaggcagaattggaccggtcccttgccccgggtgagagcaactccgagatcgcggagcgaatcaaggtccgcatccgggaacaggacttcggcgggcgtgtgctcagtgctggctccgggtcggccccgttgtctcctgagatgacggagttcatggagtcgctgctgcaggtgccgttgcgcgacgggtatgggtccaccgaggccggtggtgtgtggcgtgacggagtcctgcagcgtccgcccgtcaccgactacaagctggttgacgttccggaactcggatacttcaccacagattcgccgcatccccgtggcgagctgcggttgaagtcggagacgatgttccccggctactacaagcgcccggagaccactgccgatgtcttcgatgacgaggggtactacaagaccggtgacgtggtcgccgagctcgggccggatcacctcaagtacctcgaccgcgtcaagaacgtcctcaagctcgcgcagggagagtttgtcgcggtgtcaaagctggaggccgcttacaccggcagcccgctggtccggcagatctttgtgtacgggaacagtgaacgctcgttcctgctggctgtcgtggtcccgacacccgaagtccttgagcggtacgcagattcgccagatgcgctcaagcccttgatccaggattcgctgcagcaggtcgccaaggacgcggagctgcaatcctatgagataccgcgcgacttcatcgttgagacggtgccgttcaccgtcgagtccggattgctatcggacgcgcgaaagctgctgcgccccaagctgaaggatcactacggagagaggctggaggcgctgtacgccgaactggcggaaagccagaatgagcggctgcgccagttggccagggaggcagccacgcgcccggtcctggagacggtgaccgatgcggccgccgcgctgctgggcgcatcgtcctcggatctggctcctgatgtgcgattcatcgacctcggtggcgactcactgtcggcgctgtcgtactccgagctgctgcgcgacatctttgaggtggacgttccggtgggcgtcatcaacagcgtcgccaacgaccttgccgcgatcgcccggcacatcgaggcgcagcggaccggcgccgctacgcagccgacctttgcgtcggtccacggcaaggacgcgacggtcatcaccgccggtgaactcaccctcgacaagttcttggacgagtcactgttgaaagcggccaaggacgttcagccggcaacggccgatgtcaagaccgttctagtgaccggcggcaacggctggttgggtcgttggctggtgctcgattggctggagcggttggcacccaatggtggcaaggtctacgccctcattcgtggcgccgatgccgaagcagcccgggcacggttggacgccgtgtacgaatcgggtgatcccaagctgtccgcgcattatcgtcagctggcgcaacagagtctggaagttatcgccggcgatttcggcgaccaggatctcggtctatcccaggaagtttggcagaagctggccaaggacgtggacctgatcgtgcactccggtgccttggtgaaccacgtgctgccgtacagccagttgttcggtccgaatgtggcgggtaccgccgagatcatcaagctggcaatttcggagcggctcaagccggtcacctacctgtcgacggtgggcatcgccgaccagattccggtgacggagttcgaggaagactccgatgttcgtgtgatgtcggccgagcgccagatcaatgacggctacgcgaacggatacggcaactcaaaatgggccggcgaggtgctgttgcgggaggctcatgacctagcggggctgccggtgcgtgtgttccgctccgacatgatcctggcgcacagtgactaccacggacagctcaacgtcaccgacgtgttcacccggagcatccagagtctgctgctcaccggtgttgcaccggccagcttctatgaattggatgccgacggcaatcggcagcgcgctcactatgacggtgtgcccggcgatttcaccgccgcatcgatcaccgccatcggcggtgtgaacgtggtagacggttaccgcagcttcgacgtgttcaacccgcaccatgacggtgtctcgatggataccttcgtcgactggctgatcgacgcaggctacaagatcgcgcggatcgacgattacgaccagtggctcgcccggttcgagctggccctcaagggattgcccgagcagcagcggcaacagtcggtgttgccacttctcaagatgtacgagaagccgcaaccggcgatcgacggaagtgcacttccgaccgcagaattcagtcgcgccgtgcacgaggcgaaggtcggagacagcggtgagataccgcacgtcaccaaggagctgatcctcaagtacgccagcgatattcagctgttgggcctggtgtag

SEQ ID NO: 66 - protein, 1178 aa, Mycobacterium abscessus
MTETISTAAVPTTDLEEQVKRRIEQVVSNDPQLAALLPEDSVTEAVNEPDLPLVEVIRRLLEGYGDRPALGQRAFEFVTGDDGATVIALKPEYTTVSYRELWERAEAIAAAWHEQGIRDGDFVAQLGFTSTDFASLDVAGLRLGTVSVPLQTGASLQQRNAILEETRPAVFAASIEYLDAAVDSVLATPSVRLLSVFDYHAEVDSQREALEAVRARLESAGRTIVVEALAEALARGRDLPAAPLPSADPDALRLLIYTSGSTGTPKGAMYPQWLVANLWQKKWLTDDVIPSIGVNFMPMSHLAGRLTLMGTLSGGGTAYYIASSDLSTFFEDIALIRPSEVLFVPRVVEMVFQRFQAELDRSLAPGESNSEIAERIKVRIREQDFGGRVLSAGSGSAPLSPEMTEFMESLLQVPLRDGYGSTEAGGVWRDGVLQRPPVTDYKLVDVPELGYFTTDSPHPRGELRLKSETMFPGYYKRPETTADVFDDEGYYKTGDVVAELGPDHLKYLDRVKNVLKLAQGEFVAVSKLEAAYTGSPLVRQIFVYGNSERSFLLAVVVPTPEVLERYADSPDALKPLIQDSLQQVAKDAELQSYEIPRDFIVETVPFTVESGLLSDARKLLRPKLKDHYGERLEALYAELAESQNERLRQLAREAATRPVLETVTDAAAALLGASSSDLAPDVRFIDLGGDSLSALSYSELLRDIFEVDVPVGVINSVANDLAAIARHIEAQRTGAATQPTFASVHGKDATVITAGELTLDKFLDESLLKAAKDVQPATADVKTVLVTGGNGWLGRWLVLDWLERLAPNGGKVYALIRGADAEAARARLDAVYESGDPKLSAHYRQLAQQSLEVIAGDFGDQDLGLSQEVWQKLAKDVDLIVHSGALVNHVLPYSQLFGPNVAGTAEIIKLAISERLKPVTYLSTVGIADQIPVTEFEEDSDVRVMSAERQINDGYANGYGNSKWAGEVLLREAHDLAGLPVRVFRSDMILAHSDYHGQLNVTDVFTRSIQSLLLTGVAPASFYELDADGNRQRAHYDGVPGDFTAASITAIGGVNVVDGYRSFDVFNPHHDGVSMDTFVDWLIDAGYKIARIDDYDQWLARFELALKGLPEQQRQQSVLPLLKMYEKPQPAIDGSALPTAEFSRAVHEAKVGDSGEIPHVTKELILKYASDIQLLGLV

SEQ ID NO: 67 - DNA, 3447 bp, Streptomyces griseus
atggccgaaccgctggacgccgccaccgcgtcggcgcacgatccgggccaggggctcgccgaggccctggccgccgtcgaaccgggccgggcgctcgccgaggtcatggcgtccgtcctggagggccacggggaccggcccgccctcggcgaacgggcccgggagccggagaccgggcgtctcctcccgcacttcgacaccatcagctaccgcgaactgtggtcccgcgtccgtgcgctggccggccggtggcaccacgacccggaataccccctgggccccggcgaccggatctgcaccctcggcttcaccagcaccgactacgcgacgctcgacctggcgtgcatccacctgggggccgtgcccgtccccctcccgtccaacgccccgctgccccgactggcgccggtcgtcgaggagtccgggccgacggtactggccgcgagcgtcgaccggctcgacaccgccatcgacgtcgtcctcgcgtcgagcacgatccgccgcctcctcgtcttcgacgacggcccgggggccacccgcccgggcggggcactggcggccgcccgccaacgcctgtccggcagcccggtcaccgtcgacaccctggccggactcatcgaccggggcagggacctgccgcccccgcccctgtacatcccggacccgggggaggacccgctcgccctgctcatctacacctccggcagcaccggcgcgcccaagggcgccatgtacacccaacggctcctgggcaccgcgtggtacgggttcagctacggggcggccgacacccccgcgatcagcgtcctctacctgccgcagagccacctcgcgggccgctacgcggtgatgggatcgctcgtgaaggggggcaccggctacttcaccgctgccgacgacctgtccaccctgttcgaggacatcgccctggtccgccccacggagctgaccatggtcccgcgcctgtgcgacatgctcctccagcactaccggagcgaacgggaccgccgggccgacgaaccgggcgacatcgaggcggcggtcacgaaggcggtgcgggaggacttcctgggcgggcgcgtcgccaaggcgttcgtcggcaccgcgccgctctccgccgaactcacggcgttcgtcgagtccgtcctcggcttccacctctacaccggctacggctccaccgaagccggcggagtgctgctggacacggtggtgcagcgccctccggtcaccgactacaaactggtcgacgtccccgaactgggctactacgcgaccgacctgccccatccgcgcggcgaactgctgctgaagtcccacacgctcatccccggctactaccggcgccccgacctcaccgccgcgatcttcgacgcggacggctactaccgcaccggtgacgtcttcgccgagaccggacccgaccggctggtctacgtcgaccgcacgaaggacaccctgaagctgtcccagggcgagttcgtggccgtgtcccgcctggagaccgtcctcctcgacagccctctcgtccagcacctctacctgtacggcaacagcgagcgcgcctacctcctcgcggtggtggtgcccaccccggacgcgctggccgggtgcggcggggacaccgaggcgctcaggccgctgctcatggaatccctccgcagcgtcgccaggagggccgggctcaacgcgtacgagatcccgcgcggcatcctcgtcgagcccgagcccttcagcccggagaacggcctcttcaccgagagccacaaactgctgcgcccccgcctcaaggagcgctacgggcccgctctggagctgctgtacgaccgactggccgacgggcaggaccgccggctgcgcgagctgcggcgcaccggtgcggaccggccggtgcaggagacggtcctccgggccgcccaggccctgctgggatccccgggctccgacctccggcccggcgcgcacttcaccgacctcggcggggactccctctccgccgtctcgttctccgagctgatgaaggagatcttccacgtcgacgtcccggtcggtgcgatcatcggcccggccgccgacctggcggaggtggcgcggtacatcacggcggcccgtcggccggccggggcaccgcggcccacgcccgcctccgtgcacggggagcaccgcaccgaagtccgcgccggggacctcgccccggagaagttcctcgacgcgcccacgctcgccgccgctccggcgctgccccgccccgacggcgacgtccggacggtcctgctgaccggcgccaccggctacctcggccggttcctctgcctggagtggctggagcggctggcgccctcgggcggacggctggtctgcctcgtccgcggcagcgacgcgaccgtcgcggcgaggcggctggaggcagccttcgacagcggcgacaccgccctgctccggcgctaccggaaggcggccgggaagaccctggacgtggtcgcgggggacatcggcgaaccactgctgggcctggcggaggagacctggcgggaactggccggcgccgtggacctgatcgtgcacccggccgcgctggtcaaccacctgctgccgtacggcgaactgttcggccccaacgtcgtcggcaccgccgaagcgatccggctggcgctcaccacccggctgaagcccgtcaaccacgtctcgaccgtcgcggtctgcctcggcacccccgccgagacggccgacgagaacgccgacatccgggccgccgtcccggtacggaccaccggccaggggtacgccgacggatacgcgaccagcaaatgggccggcgaggtcctcctgcgtgaggcgcacgagcgctatggcctccccgtcgccgtcttccggtccgacatggtcctggcgcaccgcacctacaccggacaggtcaacgtccccgacgtcctcacccggctgctgctcagcctggtcgccaccggcatcgcccccggctcgttctaccgcacggacacccgtgcccactacgacggcctgccggtcgacttcaccgcggaggccgtcgtcgcgctgggcgcaccgatcaccgagggccaccggaccttcaacgtcctcaacccgcacgacgacggcgtttccctggacaccttcgtcgactggctcatcgaggccggccacccgatccggcggatcgacgaccacggtgcctggctcacccgcttcaccgcggcgctccgcgccctgccggagaagcagcggcagcactccctgctcccgctgatcggcgcctgggcggaacccggcgaaggagcccccgggccgctgctccccgcccggcgcttccacgccgccgtccgggcggcgggggtcggccccgagcgggacattccccgggtgtcgccggacctcatccgcaagtacgtcaccgacctgcgcgcactcgggctcctcgccggcccctga

SEQ ID NO: 68 - protein, 1148 aa, Streptomyces griseus
MAEPLDAATASAHDPGQGLAEALAAVEPGRALAEVMASVLEGHGDRPALGERAREPETGRLLPHFDTISYRELWSRVRALAGRWHHDPEYPLGPGDRICTLGFTSTDYATLDLACIHLGAVPVPLPSNAPLPRLAPVVEESGPTVLAASVDRLDTAIDVVLASSTIRRLLVFDDGPGATRPGGALAAARQRLSGSPVTVDTLAGLIDRGRDLPPPPLYIPDPGEDPLALLIYTSGSTGAPKGAMYTQRLLGTAWYGFSYGAADTPAISVLYLPQSHLAGRYAVMGSLVKGGTGYFTAADDLSTLFEDIALVRPTELTMVPRLCDMLLQHYRSERDRRADEPGDIEAAVTKAVREDFLGGRVAKAFVGTAPLSAELTAFVESVLGFHLYTGYGSTEAGGVLLDTVVQRPPVTDYKLVDVPELGYYATDLPHPRGELLLKSHTLIPGYYRRPDLTAAIFDADGYYRTGDVFAETGPDRLVYVDRTKDTLKLSQGEFVAVSRLETVLLDSPLVQHLYLYGNSERAYLLAVVVPTPDALAGCGGDTEALRPLLMESLRSVARRAGLNAYEIPRGILVEPEPFSPENGLFTESHKLLRPRLKERYGPALELLYDRLADGQDRRLRELRRTGADRPVQETVLRAAQALLGSPGSDLRPGAHFTDLGGDSLSAVSFSELMKEIFHVDVPVGAIIGPAADLAEVARYITAARRPAGAPRPTPASVHGEHRTEVRAGDLAPEKFLDAPTLAAAPALPRPDGDVRTVLLTGATGYLGRFLCLEWLERLAPSGGRLVCLVRGSDATVAARRLEAAFDSGDTALLRRYRKAAGKTLDVVAGDIGEPLLGLAEETWRELAGAVDLIVHPAALVNHLLPYGELFGPNVVGTAEAIRLALTTRLKPVNHVSTVAVCLGTPAETADENADIRAAVPVRTTGQGYADGYATSKWAGEVLLREAHERYGLPVAVFRSDMVLAHRTYTGQVNVPDVLTRLLLSLVATGIAPGSFYRTDTRAHYDGLPVDFTAEAVVALGAPITEGHRTFNVLNPHDDGVSLDTFVDWLIEAGHPIRRIDDHGAWLTRFTAALRALPEKQRQHSLLPLIGAWAEPGEGAPGPLLPARRFHAAVRAAGVGPERDIPRVSPDLIRKYVTDLRALGLLAGP

SEQ ID NO: 69 - DNA, 3543 bp, Mycobacterium marinum
ttgtcaattacctgtgtggatacccgtgcacagcggagcgcccgtcgcatcgagcagctttactccaccgatgcgcaattcgccgccgcccggcccagtacggcggtcggtatcgcaatcagcaagtccgggttgggattaccacagatcattcaaacggtgatggacggatacccgcaacgtccggcacttgggcagcgggcgacgcgcgttgttaccgatccgaataccgggcgtagctcggcgcagctgttggcggagttcgagaccatcacctaccgggagttgtggaaccgcaccaatgcattgaccaacgcattcgccgccgaggcacttgcggatcgcggtcagcgggtctgtgtgctgggattcgcgagcatcgactacgccaccatcgacttggcgctgatgttgctcggcgcggtatcggttccgttgccgacgaatgcggctcgcgcccagctgtgccatatcgtctccgagacccagcccagcctgatcgcctcgagtaccgaaaacctgcccgatgcaatctctttggtgctgtcgcaccgcgcaccacaccgggtggtggtgttcgactaccgccccgaactcgacgcacaccgcgaagccctcgaagccgctcgcgcgcgcctggccgccatcccggtgaccgtcgaaacgctcaccgccatcatcgcgcgcggtcgaacggtgcggccggccgaggccgattgcggcgcccagtccgctgatgcaccggcgcttttgatctatacctccggaagcaccggggcacccaagggcgtcgtctacacccgcaaccgggtggcggacttctggcgcacctcgaaagccgaggtcgaagcgaccgaacaacgaaccgctccttcgatcaccctcaacttcatgccgatgagccacgcgaacggccgccaggtgctctacgggacgctgtccaacggcggcaccgcgtatttcacggcccgcagcgacctctcgacgctcttcgatgatctcgcgttggtccggcccaccgaattgggctttccaccgcgcatttgggacatgctgttggagaggtttgggcgcgaagtcgaccgtcggctccgggacggcacagccgagggcgccgacccgggcgcgctgaaggctcgcgtggcggccgacctacgccaggtgctgctcggcggacggtatgcgctggcgatgatgggctccgcgccaatctccgagcagatgaaagcatccgtcgaatccctgctcgatctggacgtcatggagggctatggctccacggaagccggaacggtcatcatcaacaacgaggttcagcgtccccaggtgatcgactacaagctggtcgacgttgcggaactgggctatttccttaccgaccggccatatccgcggggcgaactgctggtcaaaacgcggacactgttttccggctactaccgggaccccgaagacggcgcccaggtcttcgacccggacggcttctaccggaccggcgacatcatggcccaagtcggccccgatcggctcgcctacctcgaccggcgcaacaacgtgctgaagctgtcgcagggggagttcgtcgcggtctcgcgactagaagcaatatttgccaatagcccgttggtccggcagatcttcgtctatgccaacggtgctcgcgcctacccactggcggtagtcgtgcccacccaggacgcacagtcgcgccacggtcgcgccgaactcaaggccgaactccatacatcgctgcaccgcgttgccatgtcggccggtctggcaccctacgagatcccacgcgacttcattgtcgagacaacccccttcacgccgcagaacggcctgctcaccgcaatccacaagctggcccggccgcacctcacgcagcgctatggcgcacgtctggagctgctgtacaccgagctggccgacagccagacccgccggctgcaccgattgcgccaaaccggtgggcggctgccggcgctcgagaccatcaggcgtgccgccggggcactgttgggcacggagaccaccgagccgcggcccgaggcccacttcaaagatctgggcggggattcggtatcggcggtgacgttctccaacctgctacacgacatctacggtttcgatgttccggtcggtgtgatcctcggcccggcaaccgatttgcgggcgctggccagccacgtcgagagccggcgcggtgccggatggtcggggcccagcttcgcgtcggtgcacgtgccccgggcgacctcggtacacgccggcgacctgaaactggccaagttcctggacaccaagacactcgcagctgccacgagcctgcccgctgccgatgcccgggcacggacggtgctactcaccggcgcaaccggattcctgggacgctacctggtgctggaatggctgcgccggttgcgggccgtcggcggcaagctgatctgtctggtgcgcgccgcgtccgacgaacaagcccgggttcggctggatacggccttcgatagcggcgatccgcagctgcccgagcactttcggcagctcgctgtcgaccgcctggaggtcctcgccggcgataagagcgaaccaggtctcggtctggacggcccaacctggcagcgactggccgacacggtcgacctgatcgtcgaccccgccacgctggtcaaccacgtgctgtcgtaccggcagctgttcgctcccaacgtggcgggcaccgccgagttgctccgcctcgcactcaccaccaaacgcaagccctatgcctacgtctcgaccgtcagcgtggccaaccagatcgaaccgtccgcattcaccgaagacgccgacatccgggagatcagccgcacccgaaccatcgatgacagctttgccaacggctacaccaccagcaagtgggccagcgaggtgctgttgcgtgaggctcacgatctgtgcggactgccggtcacggtctttcgttgcgacatgatcctggcggacaccagctacgccggccagctcaacctcgccgataccttcacccggctgatgctcagtgtggcggccaccgggatcgcgcccgcctcgttctaccggctgggccccgacggcaaacgccagcccgcccacttcgacggattgcccgtcgaattcatcgccgaggcggtggccaccctgggggcgcggcgccacgacgggttccaggtccaccatgtggcgaatccgcaccacgacggcgttgggttggacgagtacgtcgactggctagtcgatgccggttgccccatccggcgcattcccgactatgacgagtggctgagtcgattcgagacggcgctgcacgcgctgccggatcgcaagcgtcgtcattcactgcttccgctgctgcagaactatcgagaacccgccgagccgatccggggcggcatcgcgcccgcaccacggtttcgcggtgcggtacggcaggcgaaaatcggccgcgacaacgacattccccatgtcggcccggcgatcatcgccaagtacgccagcgacctgcagcttctcggcctggcttga

SEQ ID NO: 70 - protein, 1180 aa, Mycobacterium marinum
MSITCVDTRAQRSARRIEQLYSTDAQFAAARPSTAVGIAISKSGLGLPQIIQTVMDGYPQRPALGQRATRVVTDPNTGRSSAQLLAEFETITYRELWNRTNALTNAFAAEALADRGQRVCVLGFASIDYATIDLALMLLGAVSVPLPTNAARAQLCHIVSETQPSLIASSTENLPDAISLVLSHRAPHRVVVFDYRPELDAHREALEAARARLAAIPVTVETLTAIIARGRTVRPAEADCGAQSADAPALLIYTSGSTGAPKGVVYTRNRVADFWRTSKAEVEATEQRTAPSITLNFMPMSHANGRQVLYGTLSNGGTAYFTARSDLSTLFDDLALVRPTELGFPPRIWDMLLERFGREVDRRLRDGTAEGADPGALKARVAADLRQVLLGGRYALAMMGSAPISEQMKASVESLLDLDVMEGYGSTEAGTVIINNEVQRPQVIDYKLVDVAELGYFLTDRPYPRGELLVKTRTLFSGYYRDPEDGAQVFDPDGFYRTGDIMAQVGPDRLAYLDRRNNVLKLSQGEFVAVSRLEAIFANSPLVRQIFVYANGARAYPLAVVVPTQDAQSRHGRAELKAELHTSLHRVAMSAGLAPYEIPRDFIVETTPFTPQNGLLTAIHKLARPHLTQRYGARLELLYTELADSQTRRLHRLRQTGGRLPALETIRRAAGALLGTETTEPRPEAHFKDLGGDSVSAVTFSNLLHDIYGFDVPVGVILGPATDLRALASHVESRRGAGWSGPSFASVHVPRATSVHAGDLKLAKFLDTKTLAAATSLPAADARARTVLLTGATGFLGRYLVLEWLRRLRAVGGKLICLVRAASDEQARVRLDTAFDSGDPQLPEHFRQLAVDRLEVLAGDKSEPGLGLDGPTWQRLADTVDLIVDPATLVNHVLSYRQLFAPNVAGTAELLRLALTTKRKPYAYVSTVSVANQIEPSAFTEDADIREISRTRTIDDSFANGYTTSKWASEVLLREAHDLCGLPVTVFRCDMILADTSYAGQLNLADTFTRLMLSVAATGIAPASFYRLGPDGKRQPAHFDGLPVEFIAEAVATLGARRHDGFQVHHVANPHHDGVGLDEYVDWLVDAGCPIRRIPDYDEWLSRFETALHALPDRKRRHSLLPLLQNYREPAEPIRGGIAPAPRFRGAVRQAKIGRDNDIPHVGPAIIAKYASDLQLLGLA

SEQ ID NO: 71 - DNA, 3525 bp, Mycobacterium marinum
atgtcgccaatcacgcgtgaagagcggctcgagcgccgcatccaggacctctacgccaacgacccgcagttcgccgccgccaaacccgccacggcgatcaccgcagcaatcgagcggccgggtctaccgctaccccagatcatcgagaccgtcatgaccggatacgccgatcggccggctctcgctcagcgctcggtcgaattcgtgaccgacgccggcaccggccacaccacgctgcgactgctcccccacttcgaaaccatcagctacggcgagctttgggaccgcatcagcgcactggccgacgtgctcagcaccgaacagacggtgaaaccgggcgaccgggtctgcttgttgggcttcaacagcgtcgactacgccacgatcgacatgactttggcgcggctgggcgcggtggccgtaccactgcagaccagcgcggcgataacccagctgcagccgatcgtcgccgagacccagcccaccatgatcgcggccagcgtcgacgcactcgctgacgccaccgaattggctctgtccggtcagaccgctacccgagtcctggtgttcgaccaccaccggcaggttgacgcacaccgcgcagcggtcgaatccgcccgggagcgcctggccggctcggcggtcgtcgaaaccctggccgaggccatcgcgcgcggcgacgtgccccgcggtgcgtccgccggctcggcgcccggcaccgatgtgtccgacgactcgctcgcgctactgatctacacctcgggcagcacgggtgcgcccaagggcgcgatgtacccccgacgcaacgttgcgaccttctggcgcaagcgcacctggttcgaaggcggctacgagccgtcgatcacgctgaacttcatgccaatgagccacgtcatgggccgccaaatcctgtacggcacgctgtgcaatggcggcaccgcctacttcgtggcgaaaagcgatctctccaccttgttcgaagacctggcgctggtgcggcccaccgagctgaccttcgtgccgcgcgtgtgggacatggtgttcgacgagtttcagagtgaggtcgaccgccgcctggtcgacggcgccgaccgggtcgcgctcgaagcccaggtcaaggccgagatacgcaacgacgtgctcggtggacggtataccagcgcactgaccggctccgcccctatctccgacgagatgaaggcgtgggtcgaggagctgctcgacatgcatctggtcgagggctacggctccaccgaggccgggatgatcctgatcgacggagccattcggcgcccggcggtactcgactacaagctggtcgatgttcccgacctgggttacttcctgaccgaccggccacatccgcggggcgagttgctggtcaagaccgatagtttgttcccgggctactaccagcgagccgaagtcaccgccgacgtgttcgatgctgacggcttctaccggaccggcgacatcatggccgaggtcggccccgaacagttcgtgtacctcgaccgccgcaacaacgtgttgaagctgtcgcagggcgagttcgtcaccgtctccaaactcgaagcggtgtttggcgacagcccactggtacggcagatctacatctacggcaacagcgcccgtgcctacctgttggcggtgatcgtccccacccaggaggcgctggacgccgtgcctgtcgaggagctcaaggcgcggctgggcgactcgctgcaagaggtcgcaaaggccgccggcctgcagtcctacgagatcccgcgcgacttcatcatcgaaacaacaccatggacgctggagaacggcctgctcaccggcatccgcaagttggccaggccgcagctgaaaaagcattacggcgagcttctcgagcagatctacacggacctggcacacggccaggccgacgaactgcgctcgctgcgccaaagcggtgccgatgcgccggtgctggtgacggtgtgccgtgcggcggccgcgctgttgggcggcagcgcctctgacgtccagcccgatgcgcacttcaccgatttgggcggcgactcgctgtcggcgctgtcgttcaccaacctgctgcacgagatcttcgacatcgaagtgccggtgggcgtcatcgtcagccccgccaacgacttgcaggccctggccgactacgtcgaggcggctcgcaaacccggctcgtcacggccgaccttcgcctcggtccacggcgcctcgaatgggcaggtcaccgaggtgcatgccggtgacctgtccctggacaaattcatcgatgccgcaaccctggccgaagctccccggctgcccgccgcaaacacccaagtgcgcaccgtgctgctgaccggcgccaccggcttcctcgggcgctacctggccctggaatggctggagcggatggacctggtcgacggcaaactgatctgcctggtccgggccaagtccgacaccgaagcacgggcgcggctggacaagacgttcgacagcggcgaccccgaactgctggcccactaccgcgcactggccggcgaccacctcgaggtgctcgccggtgacaagggcgaagccgacctcggactggaccggcagacctggcaacgcctggccgacacggtcgacctgatcgtcgaccccgcggccctggtcaaccacgtactgccatacagccagctgttcgggcccaacgcgctgggcaccgccgagctgctgcggctggcgctcacctccaagatcaagccctacagctacacctcgacaatcggtgtcgccgaccagatcccgccgtcggcgttcaccgaggacgccgacatccgggtcatcagcgccacccgcgcggtcgacgacagctacgccaatggctactcgaacagcaagtgggccggcgaggtgctgttgcgcgaggcgcatgacctgtgtggcctgccggttgcggtgttccgctgcgacatgatcctggccgacaccacatgggcgggacagctcaatgtgccggacatgttcacccggatgatcctgagcctggcggccaccggtatcgcgccgggttcgttctatgagcttgcggccgacggcgcccggcaacgcgcccactatgacggtctgcccgtcgagttcatcgccgaggcgatttcgactttgggtgcgcagagccaggatggtttccacacgtatcacgtgatgaacccctacgacgacggcatcggactcgacgagttcgtcgactggctcaacgagtccggttgccccatccagcgcatcgctgactatggcgactggctgcagcgcttcgaaaccgcactgcgcgcactgcccgatcggcagcggcacagctcactgctgccgctgttgcacaactatcggcagccggagcggcccgtccgcgggtcgatcgcccctaccgatcgcttccgggcagcggtgcaagaggccaagatcggccccgacaaagacattccgcacgtcggcgcgccgatcatcgtgaagtacgtcagcgacctgcgcctactcggcctgctctga

SEQ ID NO: 72 - protein, 1174 aa, Mycobacterium marinum
MSPITREERLERRIQDLYANDPQFAAAKPATAITAAIERPGLPLPQIIETVMTGYADRPALAQRSVEFVTDAGTGHTTLRLLPHFETISYGELWDRISALADVLSTEQTVKPGDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVAKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLENGLLTGIRKLARPQLKKHYGELLEQIYTDLAHGQADELRSLRQSGADAPVLVTVCRAAAALLGGSASDVQPDAHFTDLGGDSLSALSFTNLLHEIFDIEVPVGVIVSPANDLQALADYVEAARKPGSSRPTFASVHGASNGQVTEVHAGDLSLDKFIDAATLAEAPRLPAANTQVRTVLLTGATGFLGRYLALEWLERMDLVDGKLICLVRAKSDTEARARLDKTFDSGDPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHDLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 73 - DNA, 3525 bp, Mycobacterium leprae
atgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgccgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcgcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatagcggagaccccaaactgctggcgcactaccaggaactggcaaccgaccacctggaggtcatcgccggcgacaaaggcgaagtagatctggaattggaccggcaaacgtggcgacgactggccgacacggtcgatctgatcgtcgaccccgccgccctggtcaaccacgtgctgccgtacagcgagctattcggccccaatacgttaggcaccgccgagctgattcggatcgcgctgaccagtaagcaaaagccgtacatctatgtgtcgacaatcggcgtcggtaatcagattgagccagcaaaattcaccgaagactccgacatccgagtcattagcccgacgcgcaacatcaacaacaactatgccaacggctacggcaacagcaagtgggccggcgaagtgctgctgcgcgaagctcacgacctatgcggtctgccggtcacggtcttccgctgcgacatgatcttggccgacaccagctatgccggtcagctcaacgtccccgacatgtttactcgaatgatgctgagtctagccgccaccggcatcgcacccggctcgttctacgagctagacgccgagagcaatcggcaacgcgcccactacgacggtctgcccgtcgagttcatcgccgaagcgatctccaccctgggagaccaaagcctgcacgatcgagacgggttcacgacctatcatgtaatgaacccgcacgacgacggcatcggtatggacgagtttgtggactggttaattgatgccggctgccctatacaacgcatcaacgactacgacgaatggctgcgacggtttgagatttcgctgcgcgccctgcccgaaaggcagcgtcacagctcactgttgccgttgttgcacaactaccagaagccggagaagccattgcacgggtcgctggcacccacaatccggttccgtacggccgttcaaaacgcgaacattggtcaggacaaagatattccgcatatctcgccggcaatcatcgccaaatatgtcagcgatctgcagctgctcgggctggtttga

SEQ ID NO: 74 - protein, 1174 aa, Mycobacterium leprae
MSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 75 - DNA, 3507 bp, Mycobacterium tuberculosis; identical to SEQ ID NO: 17

SEQ ID NO: 76 - protein, 1168 aa, Mycobacterium tuberculosis; identical to SEQ ID NO: 18

SEQ ID NO: 77 - DNA, 3468 bp, Nocardia farcinica
gtggaatccacacgagcgacgcgtctgcggcagcggatcgccgccctgtacgccgacgacgcgcaggtgcgcgacgcgcggccggacgaggcgatcagcacggcgctgcgggaaccgggcctgcggctgcgcgagctcgtcgccaccgtggtcgacggctaccgcgaccggcccgcgctggccgcgcgctcggtgcagccggccgtcgacgccgcgaccggtgcctgcgtggcacggttgctgcccgagtacacgacgatgagttacggcgagctcggcctgcggttgcgcgcggtggccgcggcctggcagcacgacgacgaaacccgccttcgccccggcgaattcgtcgcgaccctgggtttcaccagccccgactacgccgtcgtcgacctggcctgcgtgtgggcgggcgcggtggcggtgccgctgcaggcgagcgcgtcggtgacgcagctgaccgccatcctggccgagaccgcgcccgcaatcctggccaccggcctggacacgctgccgcacgcggtggactgtgtgctcgccggggccacgccacgggcactgcacgtgttcgacttcgaccccgccatcgacgcgcagcgcacggtgtacgaggcggcgtgtgcgcggctggccggtaccggtgtgcgcgtgcgcacgctcgccgaggtcgaggaccgcggccgggcgctgccgcctgccgtgatcgacgacggccccggcgacgaccggctcgccctgttgatctacacctccggcagtaccggcacgcccaagggggcgatgtacaccgagcggctggtcgcgctgatgtggctgggccagccgcaggtcgccgcgctcaccgtcaactacctgccgctcagccacgtcgccgggcggctggcgctgttcgggctgctcgcgcgcggcggcaccgcctacttcaccgcgcgcgccgacatgtccacgctgttcgaggatctggcgctggccaggccgaccgagctgttcgtggtgccgcgcgtgtgcgagatggtgctgcaacgattccagaccgagcggctgcggcgccaggccgacgacgaccgggtcaaggccgacctgcgcctcgaactgttcggcgaccggctgctctcggtggtgtgcggcagcgcgccgctggccccggagctgaaggcgttcatggaatcggtgctcgacctgaccctgcacgacggctacggctccaccgaggcgggcggcagcgtggtcatcgacaccaccgtgcgcaggccgccggtgctggactaccggctcgccgacgtgcccgaactgggctatttccgtaccgacaagccgcatccgcgcggcgagctgctgctcaagaccaccaccatgatccccggctactaccggcggccggagctcaacgcccagatcttcgacgaggacggcttctaccgcaccggcgacgtggtcgcggaactggcgccggaccggctcgtgtacgtcgatcgccgcaacaatgtgctcaagctggcgcagggcgagttcgtcaccatcgcccggctggaggcgatcttcgccaacagtccgctggtgcgccagatcttcgtctacggcaacagcgaacgcgcctatctgctggcggtgatcgtgccgagccgacaggcgatggcgggcgatccggccacgctgaagacgcggatcgcggagtcgttgcagctcatcggccgggacgccgagctggaggcctacgagatcccgcgcgacttcctgatcgagaccgagccgttcaccaccgaatccgggctgctctcgggcatcggcaagatcctgcgtcccgccgtcgaggcgcgctatcgcgaccggctcgaacagctctacgccgacctggccgcggcccagcaggacgagctggcggcgctgcgccgcgaggccgggcagcgtccggtgctcgagaccgtcacccgcgcggccgccgcgatcctcggcggcacggcgagcgacctgagcccggccgcgcacttcaccgatctcggcggcgattcgctggcggcgctggcgctgtcgaacctgctgcgtgagatcttcgccgtcgaggtgccggtcggcgtcatcaccggccccgcgaccgacctccgtggcctggccgcccacatcgccgcggaacgcgaaaaccgcaccgagacaccgctgttcgaccgggtgcatcccgaccagatcctgatccgggccaccgacctcgccctggagaagttcttcgacgccgaggagttggccgccgcggccaccgccgcgccgccggtcgccgagccccgggtggtgctgctgaccggtgccaacggctatctcggccggtttctgtgcctggaatggctggaacggctcgaccgcgtcgacggacggctgatctgcctggtgcgcggcgcggacgaggccgccgcgctggcccgcctggaagccgccttcgacagcggcgatcccgaattggtgcgccgcttcaaggaattggcccagcgcaggctcaccgtggtggccggcgacatcggcgagcccggcctgggcctggccaccgccacgtggcgacggctcgccgccgaggtcgagcacatcgtgcacccggccgcgctggtcaaccacgtgctgccctaccggcagctgttcgggcccaacgtggcgggcaccgcggagatcctgcggctcgcgctcaccgagcggcgcaagccgatcgacttcctgtccacggtcgccgttgccgcgcagatacccgccgaccggttcgccgaggacggcgacatccgcgtgatcagcccgacccgcacggtggaccgcggctacgccaacggctacggcaacagcaaatgggccgccgaggtgttgctgcgtgcggcgcacgaccgcttcgatctcccggtggcggtgttccgctcggacatgatcctggcccacggcagcttcgccggacagctcaacatccccgacgtgttcacccggctgctgctcagcctgctggtcaccggtatcgcgcccgcctcgttccacgccgcgacggtcaccggcgagcgcccgcgcgcccactacgacgggctgcccgcggacttcaccgctgccgcgatcaccgcgctcggggcgcgcaccgcgggattccacacctacgacgtgctcaacccgcacgacgacggcatcagcctggacaccttcgtggactggctgatcgaggccggacatcccatcgaacgcatccccgagcacagcgagtgggtcacccgtttcgagacggcgttgcacgccctgcccgaacgtcagcgcaaacactcgctgctcccgctgttgcacgcctaccgcaggccggtgcccgcgctgcgcggctcggcgctgcccgccgcggagttccgggcggcggtgcgggccgcaggcatcaccgccgacggtgacatcccgcacctgacgcgcgcgctgatcgagaagtacgtcgccgatctccgcctgcacggactgttgtag

SEQ ID NO: 78 - protein, 1155 aa, Nocardia farcinica
VESTRATRLRQRIAALYADDAQVRDARPDEAISTALREPGLRLRELVATVVDGYRDRPALAARSVQPAVDAATGACVARLLPEYTTMSYGELGLRLRAVAAAWQHDDETRLRPGEFVATLGFTSPDYAVVDLACVWAGAVAVPLQASASVTQLTAILAETAPAILATGLDTLPHAVDCVLAGATPRALHVFDFDPAIDAQRTVYEAACARLAGTGVRVRTLAEVEDRGRALPPAVIDDGPGDDRLALLIYTSGSTGTPKGAMYTERLVALMWLGQPQVAALTVNYLPLSHVAGRLALFGLLARGGTAYFTARADMSTLFEDLALARPTELFVVPRVCEMVLQRFQTERLRRQADDDRVKADLRLELFGDRLLSVVCGSAPLAPELKAFMESVLDLTLHDGYGSTEAGGSVVIDTTVRRPPVLDYRLADVPELGYFRTDKPHPRGELLLKTTTMIPGYYRRPELNAQIFDEDGFYRTGDVVAELAPDRLVYVDRRNNVLKLAQGEFVTIARLEAIFANSPLVRQIFVYGNSERAYLLAVIVPSRQAMAGDPATLKTRIAESLQLIGRDAELEAYEIPRDFLIETEPFTTESGLLSGIGKILRPAVEARYRDRLEQLYADLAAAQQDELAALRREAGQRPVLETVTRAAAAILGGTASDLSPAAHFTDLGGDSLAALALSNLLREIFAVEVPVGVITGPATDLRGLAAHIAAERENRTETPLFDRVHPDQILIRATDLALEKFFDAEELAAAATAAPPVAEPRVVLLTGANGYLGRFLCLEWLERLDRVDGRLICLVRGADEAAALARLEAAFDSGDPELVRRFKELAQRRLTVVAGDIGEPGLGLATATWRRLAAEVEHIVHPAALVNHVLPYRQLFGPNVAGTAEILRLALTERRKPIDFLSTVAVAAQIPADRFAEDGDIRVISPTRTVDRGYANGYGNSKWAAEVLLRAAHDRFDLPVAVFRSDMILAHGSFAGQLNIPDVFTRLLLSLLVTGIAPASFHAATVTGERPRAHYDGLPADFTAAAITALGARTAGFHTYDVLNPHDDGISLDTFVDWLIEAGHPIERIPEHSEWVTRFETALHALPERQRKHSLLPLLHAYRRPVPALRGSALPAAEFRAAVRAAGITADGDIPHLTRALIEKYVADLRLHGLL

SEQ ID NO: 79 - DNA, 3525 bp, Nocardia sp.; identical to SEQ ID NO: 15

SEQ ID NO: 80 - protein, 1174 aa, Nocardia sp.; identical to SEQ ID NO: 16

SEQ ID NO: 81 - DNA, 3522 bp, Mycobacterium avium
atgtcgactgccacccatgacgaacgactcgaccgtcgcgtccacgaactcatcgccaccgacccgcaattcgccgccgcccaacccgacccggcgatcaccgccgccctcgaacagcccgggctgcggctgccgcagatcatccgcaccgtgctcgacggctacgccgaccggccggcgctgggacagcgcgtggtggagttcgtcacggacgccaagaccgggcgcacgtcggcgcagctgctcccccgcttcgagaccatcacgtacagcgaagtagcgcagcgtgtttcggcgctgggccgcgccctgtccgacgacgcggtgcaccccggcgaccgggtgtgcgtgctgggcttcaacagcgtcgactacgccaccatcgacatggcgctgggcgccatcggcgccgtctcggtgccgctgcagaccagcgcggcaatcagctcgctgcagccgatcgtggccgagaccgagcccaccctgatcgcgtccagcgtgaaccagctgtccgacgcggtgcagctgatcaccggcgccgagcaggcgcccacccggctggtggtgttcgactaccacccgcaggtcgacgaccagcgcgaggccgtccaggacgccgcggcgcggctgtccagcaccggcgtggccgtccagacgctggccgagctgctggagcgcggcaaggacctgcccgccgtcgcggagccgcccgccgacgaggactcgctggccctgctgatctacacctccgggtccaccggcgcccccaagggcgcgatgtacccacagagcaacgtcggcaagatgtggcgccgcggcagcaagaactggttcggcgagagcgccgcgtcgatcaccctgaacttcatgccgatgagccacgtgatgggccgaagcatcctctacggcacgctgggcaacggcggcaccgcctacttcgccgcccgcagcgacctgtccaccctgcttgaggacctcgagctggtgcggcccaccgagctcaacttcgtcccgcggatctgggagacgctgtacggcgaattccagcgtcaggtcgagcggcggctctccgaggccggggacgccggcgaacgtcgcgccgtcgaggccgaggtgctggccgagcagcgccagtacctgctgggcgggcggttcaccttcgcgatgacgggctcggcgcccatctcgccggagctgcgcaactgggtcgagtcgctgctcgaaatgcacctgatggacggctacggctccaccgaggccggaatggtgttgttcgacggggagattcagcgcccgccggtgatcgactacaagctggtcgacgtgccggacctgggctacttcagcaccgaccggccgcatccgcgcggcgagctgctgctgcgcaccgagaacatgttcccgggctactacaagcgggccgaaaccaccgcgggcgtcttcgacgaggacggctactaccgcaccggcgacgtgttcgccgagatcgccccggaccggctggtctacgtcgaccgccgcaacaacgtgctcaagctggcgcagggcgaattcgtcacgctggccaagctggaggcggtgttcggcaacagcccgctgatccgccagatctacgtctacggcaacagcgcccagccctacctgctggcggtcgtggtgcccaccgaggaggcgctggcctcgggtgaccccgagacgctcaagcccaagatcgccgactcgctgcagcaggtcgccaaggaggccggcctgcagtcctacgaggtgccgcgcgacttcatcatcgagaccaccccgttcagcctggaaaacggtctgctgaccgggatccggaagctggcgtggccgaaactgaagcagcactacggggaacggctggagcagatgtacgccgacctggccgccggacaggccaacgagctggccgagctgcgccgcaacggtgcccaggcgccggtgttgcagaccgtgagccgcgccgcgggcgccatgctgggttcggccgcctccgacctgtcccccgacgcccacttcaccgatctgggcggagactcgttgtcggcgttgacattcggcaacctgctgcgcgagatcttcgacgtcgacgtgccggtaggcgtgatcgtcagcccggccaacgacctggcggccatcgcgagctacatcgaggccgagcggcagggcagcaagcgcccgacgttcgcctcggtgcacggccgggacgcgaccgtggtgcgcgccgccgacctgacgctggacaagttcctcgacgccgagacgctggccgccgcgccgaacctgcccaagccggccaccgaggtgcgcaccgtgctgctgaccggcgccaccggcttcctgggccgctacctggccctggaatggctggagcggatggacatggtggacggcaaggtcatcgccctggtccgggcccgctccgacgaggaggcacgcgcccggctggacaagaccttcgacagcggcgacccgaaactgctcgcgcactaccagcagctggccgccgatcacctggaggtcatcgccggcgacaagggcgaggccaatctgggcctgggccaagacgtttggcaacgactggccgacacggtcgacgtgatcgtcgaccccgccgcgctggtcaaccacgtgttgccgtacagcgagctgttcgggcccaacgccctgggcaccgcggagctgatccggctggcgctgacgtccaagcagaagccgtacacctacgtgtccaccatcggcgtgggcgaccagatcgagccgggcaagttcgtcgagaacgccgacatccggcagatgagcgccacccgggcgatcaacgacagctacgccaacggctatggcaacagcaagtgggccggcgaggtgctgctgcgcgaggcgcacgacctgtgcgggctgcccgtcgcggtgttccgctgcgacatgatcctggccgacaccacgtatgccgggcagctcaacctgccggacatgttcacccggctgatgctgagcctggtggccaccgggatcgcgcccggctcgttctacgagctcgacgccgacggcaaccggcagcgggcgcactacgacggcctgccggtcgagttcatcgccgcggcgatctcgacgctgggttcgcagatcaccgacagcgacaccggcttccagacctaccacgtgatgaacccctacgatgacggcgtcggtctggacgagtacgtcgattggctggtggacgccggctattcgatcgagcggatcgccgactactccgaatggctgcggcggttcgagacctcgctgcgggccctgccggaccggcagcgccagtactcgctgctgccgctgctgcacaactaccgcacgccggagaagccgatcaacgggtcgatagctcccaccgacgtgttccgggcagcggtgcaggaggcgaaaatcggccccgacaaagacattccgcacgtgtcgccgccggtcatcgtcaagtacatcaccgacctgcagctgctcgggctgctctga

SEQ ID NO: 82 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYSEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLVYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGVGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 83 - DNA, 3507 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccttggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatccgcccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 84 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIRPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 85 - DNA, 3507 bp, Mycobacterium bovis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctactacgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctactcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacacctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 86 - protein, 1168 aa, Mycobacterium bovis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYYVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHTSLLPLLHNYREPAKPICGSIAPTDQFRAAVQEAKIGPDKDIPHLTAAIIAKYISNLRLLGLL

SEQ ID NO: 87 - DNA, 3567 bp, Mycobacterium leprae
gtgtggcgccaacagtctatttctcatcgcaaggaatctgttatgtcgactatcactaagcaggaaaagcagctcgcacgccgcgttgacgacctcaccgccaacgacccgcagttcgccgccgccaaacccgacccggcggtagccgccgcccttgcccagcccgggcttcgactgccccaaatcatccagaccgcgctggacggttacgcggagcggccggcactgggccagcgcgtcgccgagttcaccaaagaccctaagaccggacgcacctcgatggagctgctccccagctttgagaccatcacctaccgccagttgggcgaccgtgtcggagcgctggcgcgcgcctggaggcacgacctactgcacgccggctaccgggtctgcgtgctaggtttcaacagtgtcgattacgccatcatcgacatggcgctcggcgtgattggtgctgtggcggttccactgcagaccagtgcggcgatcacccagctgcagtcgatcgtgaccgagaccgaacccagtatgatcgcgacgagcgtaaaccagctgcccgatactgtcgagctgatcctgtctggccaggcgccagcgaagctcgttgtgtttgactaccaccccgaggtcgacgagcagcatgacgcagtggcaaccgcccgggcgcggttggcggacagtagcgtggtggtcgagagcctgaccgaggtcctcggtcgcggcaagacgctgccagctacgccgatccccgtggccgatgactctgctgacccgttggcgttgctgatctacacatctggcagcaccggcgcacccaagggcgcgatgtatctgcaaagcaatgtcggcaagatgtggcgccggtcagacggaaactggttcgggccaaccgccgcgtcaatcactcttaacttcatgccgatgagccacgtcatgggccgcggaatcctctacggcacgctcggtaacggcggcacggcttacttcgccgcccgcagcgacctctcgacgctgctggaggatctcaagctggtgcggccgaccgagttgaactttgtaccgcgcatctgggaaaccctctacgatgaatccaaacgcgcagttgaccgtcggttagccaacagcggctccgccgaccgtgcagccatcaaagccgaagttatggatgaacagcggcaatccctgctgggaggacggtacatcgcggctatgacgggctcggcgccaacctccccggagttgaaacacggggtcgagtccctactcgaaatgcatctgttggaaggctacggctccaccgaagccggcatggtcttgtttgacggcgaagtgcaacgtccgccggttatcgattacaagctggtcgacgttccggatttgggctacttcagcaccgaccagccttatccgagaggtgaattgctgctcaagacccagaacatgttccccggctactacaagcgtcctgaggttaccgccaccgtgttcgacagcgacggttactaccagaccggagacattgtcgccgaagtcggtcccgaccggctcgtgtacgtcgatcgccgcaacaacgtgctgaaactcgcgcagggccagttcgtcaccgtcgcgaaactcgaggcagcgttcagcaatagcccactggtccggcagatctacatctatggcaacagcgcacacccctacctgttggctgttgtggtgccgaccgaggatgcgttggctaccaatgacattgaggtgctcaaaccgctgattatcgattctttacagaaagtagcgaaagaagccgacctgcagtcctacgaggtgccgcgcgacttaatcgtcgagactacaccgttcagcctggagaatggcctgctcaccggtattcgcaagctggcgtggccgaagctcaagcagcactacggcgcgcgactcgaacagctctacgccgatctggttgaaggtcaggcaaatgcactgcacgtgctaaaacaaagcgtggcgaacgctccggtactgcagacggtgagccgagccgtgggcaccattctgggagtggcgaccaccgatttgccgtcgaatgcgcacttcaccgacttaggaggagactcgttgtccgcgctgacattcggtagcctgctacgcgaactcttcgacatcgatgtgccggtgggcgtcattgtcagccctgtcaacaacttggtggcgatcgccgactacatcgagcgcgagcggcagggcacgaagcggcccactttcattgccatacacggtcgtgacgctggcaaagtgcatgccagtgacctcactctagacaaattcatcgatgtatcaacgctgactgccgcgcccgtattggcgcaacccggcaccgaggtgcgcaccgtcctgttgaccggcgctaccggcttcctggggcgctacttggccctgaaatggctcgaacggatggacctggtcgaagggaaggtaatcgctctggtaagagccaagtccaacgaggacgctcgggcccggctcgacaagaccttcgatagcggagaccccaaactgctggcgcactaccaggaactggcaaccgaccacctggaggtcatcgccggcgacaaaggcgaagtagatctggaattggaccggcaaacgtggcgacgactggccgacacggtcgatctgatcgtcgaccccgccgccctggtcaaccacgtgctgccgtacagcgagctattcggccccaatacgttaggcaccgccgagctgattcggatcgcgctgaccagtaagcaaaagccgtacatctatgtgtcgacaatcggcgtcggtaatcagattgagccagcaaaattcaccgaagactccgacatccgagtcattagcccgacgcgcaacatcaacaacaactatgccaacggctacggcaacagcaagtgggccggcgaagtgctgctgcgcgaagctcacgacctatgcggtctgccggtcacggtcttccgctgcgacatgatcttggccgacaccagctatgccggtcagctcaacgtccccgacatgtttactcgaatgatgctgagtctagccgccaccggcatcgcacccggctcgttctacgagctagacgccgagagcaatcggcaacgcgcccactacgacggtctgcccgtcgagttcatcgccgaagcgatctccaccctgggagaccaaagcctgcacgatcgagacgggttcacgacctatcatgtaatgaacccgcacgacgacggcatcggtatggacgagtttgtggactggttaattgatgccggctgccctatacaacgcatcaacgactacgacgaatggctgcgacggtttgagatttcgctgcgcgccctgcccgaaaggcagcgtcacagctcactgttgccgttgttgcacaactaccagaagccggagaagccattgcacgggtcgctggcacccacaatccggttccgtacggccgttcaaaacgcgaacattggtcaggacaaagatattccgcatatctcgccggcaatcatcgccaaatatgtcagcgatctgcagctgctcgggctggtttga

SEQ ID NO: 88 - protein, 1188 aa, Mycobacterium leprae
VWRQQSISHRKESVMSTITKQEKQLARRVDDLTANDPQFAAAKPDPAVAAALAQPGLRLPQIIQTALDGYAERPALGQRVAEFTKDPKTGRTSMELLPSFETITYRQLGDRVGALARAWRHDLLHAGYRVCVLGFNSVDYAIIDMALGVIGAVAVPLQTSAAITQLQSIVTETEPSMIATSVNQLPDTVELILSGQAPAKLVVFDYHPEVDEQHDAVATARARLADSSVVVESLTEVLGRGKTLPATPIPVADDSADPLALLIYTSGSTGAPKGAMYLQSNVGKMWRRSDGNWFGPTAASITLNFMPMSHVMGRGILYGTLGNGGTAYFAARSDLSTLLEDLKLVRPTELNFVPRIWETLYDESKRAVDRRLANSGSADRAAIKAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDSDGYYQTGDIVAEVGPDRLVYVDRRNNVLKLAQGQFVTVAKLEAAFSNSPLVRQIYIYGNSAHPYLLAVVVPTEDALATNDIEVLKPLIIDSLQKVAKEADLQSYEVPRDLIVETTPFSLENGLLTGIRKLAWPKLKQHYGARLEQLYADLVEGQANALHVLKQSVANAPVLQTVSRAVGTILGVATTDLPSNAHFTDLGGDSLSALTFGSLLRELFDIDVPVGVIVSPVNNLVAIADYIERERQGTKRPTFIAIHGRDAGKVHASDLTLDKFIDVSTLTAAPVLAQPGTEVRTVLLTGATGFLGRYLALKWLERMDLVEGKVIALVRAKSNEDARARLDKTFDSGDPKLLAHYQELATDHLEVIAGDKGEVDLELDRQTWRRLADTVDLIVDPAALVNHVLPYSELFGPNTLGTAELIRIALTSKQKPYIYVSTIGVGNQIEPAKFTEDSDIRVISPTRNINNNYANGYGNSKWAGEVLLREAHDLCGLPVTVFRCDMILADTSYAGQLNVPDMFTRMMLSLAATGIAPGSFYELDAESNRQRAHYDGLPVEFIAEAISTLGDQSLHDRDGFTTYHVMNPHDDGIGMDEFVDWLIDAGCPIQRINDYDEWLRRFEISLRALPERQRHSSLLPLLHNYQKPEKPLHGSLAPTIRFRTAVQNANIGQDKDIPHISPAIIAKYVSDLQLLGLV

SEQ ID NO: 89 - DNA, 3816 bp, Dictyostelium discoideum
atgttaaaacatattaaaaattttttaactagaaaagaagaaagaaaagaaaaagaagtagagaaattaaaagatggagtatcaataactgaggttaaacaatcgaacctagtagtttattcatgcaatggttgtggatcagagatatggccaccaaaacaagagagatatgcatgtaatgaatgctcaaatttcgatttatgtagtgagtgttatagaaaagaaatgatattaataaatggtacacaagaagagaaagataaattagttagtggggagagtaataatggaataaagtacgagccagtgagacattatgatccatcaccattacctcatcaattaacattagagaatgagactcaatttcaattagtttatagtttacgtggtaattcaacatttgaaacaatggagaaatcatttaaatactttaaaaacagaccatgtcttggtattagagagagattaggagaggataatgttttatcagaaagatataaatggttaacatatggtgaagtgtatgagaaatctttaaccttggcaaaggcattaactaatttcatcgaaagaagagatttcatttcaatctatatggataattgcttagaatggtatttcacagattttgcatcattatgggccggattaatagtggtaccattacatcatgcttcaaatagttttaatcttttagagattctttggaattccgaatcaaaatgtatagtttgttctggtgaatcatttaaaaatttaatagaactttatgatcaattgactgagcaagataaattagagaaaccaatagtgttgaaattgatagttcataaggaggatctattcgatcagtcattagtcgatagattgccaagtggcgtagaatttaaaactttcaatgagatgattaaaattggggaatcattaagtcaggctaaatatgaatttgtcccagttggtccaaatgatctttcctcggtgacttatacaagtggtagtactggtgtaccaaaaggtgtaatgaagttagattcaattttcaatttactaattgtcaattcctatgttcaattcccaaatgcagtttatagttataataccctatcacatagtcaacgtttaagtgattggagatatatttatatgggtggtagagtagctatctattcaggtgatatgaatctattatttgaagatttagccttggttagacctcattcattttgggctgtaccaagattttggaatttattattcacccagttcaagagtgatctaaagcaatacatgtttgaaaatccacaattggatgaaagaactgccacactctattgctataaaggtattagaaagttattaggtgatagaattaataatctagtgactggtggtgctccgactgcaaatgaagtactcaaatttatgagtgattgttggaaagatataaacatttcaaattcttatggtttaactgaagtatcaggtgtttgtatagatggttatatctctgacgaagtagaattcaaaattgaaccagtaccttcttttggatattacccaactgatttaccacatcctcgtggtgaattggttgtaaaatcatcaacaatgtctgcaggttattataaaaatactcaattaacttcagaatcatttgaaggtggttggtttaaaactggtgatgtcgtagaattaattggagttagaaaagttaaaatcattgatagaattaaacatgccttcaaattggcaaatggagaattcgttacaccagaaccattggaaaataatttcgtttcactttgtattaatcaaatttttatttatggtaattcacttaaaacatttttagttgcaattgttaaaccatcacaagattgtttaaaacaattaggacttcaagatataccaatcgatcaattaattgaaaatccaactttaaaatcaaaacttttatcagagattaataaaatttcaaaagaaaaaaaactagcaaattatgaaattccaaaaattattacaatagatttcactgaatggacaattgataataaattaatcactggttctggtaaatttaatagaggtgaattatataaattttataaaattaaaattaataatatgtttgatataattgataaaattcaacaaggtttaagaaataataataataataataataatgataatattaataataatgataataataataataatgaatcaaataaagataattttgaaaattatataaaatcaattttaaatttagacggtagaattgaagataataattttaatttagagaatttatcatttattcaaattggtggtgattcgttaggtgctgttaaattatcatcacttttaaaagaaaaagaaaatattgatatttcaccttcaacaattttaaatcaaaattttaatttatcttcattatcgaaattaataaatgaaaaagaatcaaatcaatcaattgttgaagattttaaagaaaattttaaaatcaattggaatgaagagatgattttagatgaagatattaaaaaatcaattgaccaaattaaaaatgcacaaccatcatcaactccctcttcatcaaaatcaacaccatcacaatcatcatcatcaccaccaccatcattaaattcaaataatattggtcaaaatgcttttcatatgaaatcaatatttattacaggtgttacaggttatttaggtacatttttattatttaatttattagaggataaatcaattggtattgagagaatttattgtttagttagaaatgtaaagaatgaagaagaaggttttaaattaattgaaagaatatttgaaaaatcttgtatcaatggtatgaatgaaaagattagagaaaaggtaattccagtttgtggtgacttatcaaaaccatttttcggtgtttctactgaaaccttcaaaatgttatctttagcggtcgatatggtaattcacaatggtgccattgttaatatggcctatccatatgcgaatatgaaatcaacaaatgttacatcaactcgtgatatcctaagattatgcactaccggaagagcctcttttaaaaagttggtctacgtttcaacagttggtgtattctttggaaatggtgatgaaaagatagatgaatcaacagcaccatcaactttctttttagatcatggtaatggttataaccaaacaaaactaatatcagatatacttgttagagaagcggcttcatatggtttaccaacaatgattttcagaccaggtacaatctttagtcatacccaatctggtttcaacaatcaaaatgattcaatcggtttaataattaaaggtatcctaggttcgagttcctatccaactaaaaaagattactctagtggcgatttaaatctttcaccagttgattgggtatcatcttcaatggtttctttaattaagcatcttccattttggtgtaataatacaaaaatttatcatatggtaaatgataatcgtttatctttagatttgctatgtcaatatataaataaagaaaaacaattagaagaaattaattatttcgattggatcgatgctcaacttaattcttcaaataatccattgtattctattaaacatttatttaaaaagaatgatcgtttcccaattggttctcagtcaattaaaaatccaaaaactattaaagatttagaatcaattggtgaacttcaatgtcaaccaatatctgattccacagtaatcaattatgtaaaatatttaatctcaaataatttaattcaaacaattaataaataa

SEQ ID NO: 90 - protein, 1271 aa, Dictyostelium discoideum
MLKHIKNFLTRKEERKEKEVEKLKDGVSITEVKQSNLVVYSCNGCGSEIWPPKQERYACNECSNFDLCSECYRKEMILINGTQEEKDKLVSGESNNGIKYEPVRHYDPSPLPHQLTLENETQFQLVYSLRGNSTFETMEKSFKYFKNRPCLGIRERLGEDNVLSERYKWLTYGEVYEKSLTLAKALTNFIERRDFISIYMDNCLEWYFTDFASLWAGLIVVPLHHASNSFNLLEILWNSESKCIVCSGESFKNLIELYDQLTEQDKLEKPIVLKLIVHKEDLFDQSLVDRLPSGVEFKTFNEMIKIGESLSQAKYEFVPVGPNDLSSVTYTSGSTGVPKGVMKLDSIFNLLIVNSYVQFPNAVYSYNTLSHSQRLSDWRYIYMGGRVAIYSGDMNLLFEDLALVRPHSFWAVPRFWNLLFTQFKSDLKQYMFENPQLDERTATLYCYKGIRKLLGDRINNLVTGGAPTANEVLKFMSDCWKDINISNSYGLTEVSGVCIDGYISDEVEFKIEPVPSFGYYPTDLPHPRGELVVKSSTMSAGYYKNTQLTSESFEGGWFKTGDVVELIGVRKVKIIDRIKHAFKLANGEFVTPEPLENNFVSLCINQIFIYGNSLKTFLVAIVKPSQDCLKQLGLQDIPIDQLIENPTLKSKLLSEINKISKEKKLANYEIPKIITIDFTEWTIDNKLITGSGKFNRGELYKFYKIKINNMFDIIDKIQQGLRNNNNNNNNDNINNNDNNNNNESNKDNFENYIKSILNLDGRIEDNNFNLENLSFIQIGGDSLGAVKLSSLLKEKENIDISPSTILNQNFNLSSLSKLINEKESNQSIVEDFKENFKINWNEEMILDEDIKKSIDQIKNAQPSSTPSSSKSTPSQSSSSPPPSLNSNNIGQNAFHMKSIFITGVTGYLGTFLLFNLLEDKSIGIERIYCLVRNVKNEEEGFKLIERIFEKSCINGMNEKIREKVIPVCGDLSKPFFGVSTETFKMLSLAVDMVIHNGAIVNMAYPYANMKSTNVTSTRDILRLCTTGRASFKKLVYVSTVGVFFGNGDEKIDESTAPSTFFLDHGNGYNQTKLISDILVREAASYGLPTMIFRPGTIFSHTQSGFNNQNDSIGLIIKGILGSSSYPTKKDYSSGDLNLSPVDWVSSSMVSLIKHLPFWCNNTKIYHMVNDNRLSLDLLCQYINKEKQLEEINYFDWIDAQLNSSNNPLYSIKHLFKKNDRFPIGSQSIKNPKTIKDLESIGELQCQPISDSTVINYVKYLISNNLIQTINK

SEQ ID NO: 91 - DNA, 3333 bp, Streptomyces rimosus
atgaccgacacgtacgtttcttcacgcccgttatccaagcggccccaggtcccgggtgcccgcacgccggcgcccggctacccacgggacagccgcatcccggagctgttcgaggcacaggccgcggcgctgccgcaggccccggcggcccggcacggggaccgcaccctgacctacggccaactcgacgcccacgccgacgcgttggcggaccggctggctgccggcggggtccggccgggtgacctgatcggcgtgtgcggcagccgttccctggaggcgctggtggcgctgctgggcatcctcaaggccggctgcgcgtacgtaccgctcgacgaggaactgccgccggcccggctgcgggccatggccgaggacgcgggcatcagcgccgcggtcaccctgccgggcagcacgcgccgggtgcggggtctacgcgtgtcagtcgaggtcggctccctcggccggcccgcccccgagcgcgcgagcggccccgcccccgaccgggccaccggctccgccgccgactgcgcctacgtcgccttcacttccggcacgaccggccggcccaagcccgtagcgctgtcccaccggggcgtggtccgcctcgtgctgtccgaccccggcctcacgccacccggaccgggcgacggagtgctgcacgcctacagcctgtcctccgacgcctcgaccatcgagatctggggcgcgctgctgaccggcgcctgcctggtcgtcgccgaccgcgaggaactgctctcgcccaccgccctggaacggctgctccgcgcgggcggcgtcaccgtggcgtacctgacgacgagcgtcttccacctcgtcgcccggacccgccccgaggcgctggccggcctgcggttcgtctccgcgggcggggaggcgatggacccgcgcctggcgaacgccgtcctcgcggcctgcccccgcaccacggtggtcaacttctacggcccgaccgagaacgccgtggtctccaccgcccatgtgctcacccccctccccgaggacgccgcacacgtccccctgggacgccccttcggcgcttccacctgccacgtcctgcgggccgacggctcgcccgcgcggccgggcgaggaaggggagctgtacgtcggcggggacgggctggcgctgggctacctcggcgacccgcagctgaccgccgagcggttcgtgacgctgcccgcggtcgagccggacggaccgctgtaccggaccggcgaccgggccgtacggcacgccgacgggctgctggagtaccgcggacggctcgaccgccaggtcaagctgcgcggcgcccgcatcgagctggacgaggtggagacccgcttacgggcccaccccgaggtcggcgaagcggccgtcgaggtcgacgggcactccctgaccgcctacgtcacggccaccgtccccggccgcccgctgccgctggccgacctgcgcgcgtactgcgccaagtggctgcccccgcaggccgtcccggccctgatacccctggaccgcttcccggtcaccagcggcggcaagatcgaccgcagccgtctgaagccgaccgcgccaccgcccggccccgaagacaccgcggaggccgcgcggcgcccggacgagccggaggccaccgacggcctgtccggtctcctctcggaagtgtggcaccaggtgctgcgtgtccggcccacgccccgggacgacttcttcctcctcggcggcgactccctgctcgcctcggagaccgtcacccgcaccctcgccgtactcggcctcgacgcggccctgggctccaccctcatcagggcgctgctggccgcgcccaccctcgaaagcttcaccgccgccgtacgcggagtccgcggcggcaccggcggaccggccggcggccaggaaccggccgtcgacttcgccgcggagaccggactcggcttcgccctcccgcccgccgaaggcccggcgccgaacccgcacgaccccgaggacgtcctgctcacgggcgcttccggcttcgtcggcggattcctgctgcaccgtctgctgcacgcgacggccgcccgcgtccactgccccgtacgggcgacgagccccgcccacgcccggcagcgggtccgcaccgccctcacccgctacgggctgcacctcgacgaggccgactggcagcgcgtggagtgcttccccggggacctgacccagccgcgcctggggctcgaccacgagcgcgccgacgcactggcccagcgcctggacctgatcgtgcacaacggtgcccgggtcaacttcctctacccctaccagcagttgcgcccggcgaacgtcgacggaacccgcgaggtcgtccggatcgccgcgcgccgccgggtgccggtgcacttcgtgtccaccgtcgcagtcgtcgcgggcttcggcaccgccggggtgcgcgaggtggacgaagatctgccgccggcccacgccgacgggctgaccatggggtacgcggagagcaagtgggtcgccgaaggggtgctgcggcaggcggccgcgcagggcctgccggtggccgtgtaccggccgtacgaggtcacgggcgaccggacgcacggcgcgtgcaacaccgagacggccatctgctcgctgttcaagatgatcgccgacacgggagtggcccccgacatcaagctgccgatggacttcgtacccgtcgaccacctcgccgagtccctggtgcacatcgccacgcaccggccggccgacggccgggtctaccacctgaccaacccgcgcccggcgatgctgtcggacgtcctcgaccggatgcgcgcggcgggcttcaccctgcgcaccctgccgtacgacgcgtgggtcggcgagctcgtccggcacgtcgccgagaacccgacgagcgccacggctccgttcgtgtccctgtgcgtggaccgcagccgcaccgccgacatgtccgtcaaggagatgtacctcaagggcaccttcccggtcctggggcggcgcaacgccgaggaggcgctggccggcagcgggctgcactgcccgccggtcgactccgctctgctggaccgctacctggagtacttcttcacctccggctacctcacgcgcccggcggccggccccgggcccgaatccgaggccgagcgaataccggaggacgagccggtgtccgggaccgaaccgatatccgggaccgaaccgatttctgccgccgagccgatatccgggaccgaaccgatttctgccgccgggccgatatccgggaccgagccgatacccgccgccgagccgatatccgggaccgcagccgcagcccgcacggagcgcagccgatga

SEQ ID NO: 92 - protein, 1110 aa, Streptomyces rimosus
MTDTYVSSRPLSKRPQVPGARTPAPGYPRDSRIPELFEAQAAALPQAPAARHGDRTLTYGQLDAHADALADRLAAGGVRPGDLIGVCGSRSLEALVALLGILKAGCAYVPLDEELPPARLRAMAEDAGISAAVTLPGSTRRVRGLRVSVEVGSLGRPAPERASGPAPDRATGSAADCAYVAFTSGTTGRPKPVALSHRGVVRLVLSDPGLTPPGPGDGVLHAYSLSSDASTIEIWGALLTGACLVVADREELLSPTALERLLRAGGVTVAYLTTSVFHLVARTRPEALAGLRFVSAGGEAMDPRLANAVLAACPRTTVVNFYGPTENAVVSTAHVLTPLPEDAAHVPLGRPFGASTCHVLRADGSPARPGEEGELYVGGDGLALGYLGDPQLTAERFVTLPAVEPDGPLYRTGDRAVRHADGLLEYRGRLDRQVKLRGARIELDEVETRLRAHPEVGEAAVEVDGHSLTAYVTATVPGRPLPLADLRAYCAKWLPPQAVPALIPLDRFPVTSGGKIDRSRLKPTAPPPGPEDTAEAARRPDEPEATDGLSGLLSEVWHQVLRVRPTPRDDFFLLGGDSLLASETVTRTLAVLGLDAALGSTLIRALLAAPTLESFTAAVRGVRGGTGGPAGGQEPAVDFAAETGLGFALPPAEGPAPNPHDPEDVLLTGASGFVGGFLLHRLLHATAARVHCPVRATSPAHARQRVRTALTRYGLHLDEADWQRVECFPGDLTQPRLGLDHERADALAQRLDLIVHNGARVNFLYPYQQLRPANVDGTREVVRIAARRRVPVHFVSTVAVVAGFGTAGVREVDEDLPPAHADGLTMGYAESKWVAEGVLRQAAAQGLPVAVYRPYEVTGDRTHGACNTETAICSLFKMIADTGVAPDIKLPMDFVPVDHLAESLVHIATHRPADGRVYHLTNPRPAMLSDVLDRMRAAGFTLRTLPYDAWVGELVRHVAENPTSATAPFVSLCVDRSRTADMSVKEMYLKGTFPVLGRRNAEEALAGSGLHCPPVDSALLDRYLEYFFTSGYLTRPAAGPGPESEAERIPEDEPVSGTEPISGTEPISAAEPISGTEPISAAGPISGTEPIPAAEPISGTAAAARTERSR

SEQ ID NO: 93 - DNA, 519 bp, Escherichia coli
atggtagataaacgcgaatcctatacaaaagaagaccttcttgcctctggtcgcggtgaactgtttggcgctaaaggcccgcaattgccagcaccgaacatgctgatgatggaccgtgtggtcaaaatgaccgaaacgggtggtaacttcgacaaagggtatgttgaagcagaactggatatcaatccggatctgtggttcttcggatgccactttattggcgatccggttatgccgggatgcctgggcctggacgcaatgtggcagctggtagggttctacctcggctggctgggcggcgaaggtaaaggccgcgcgctgggcgttggcgaagtgaaattcactggtcaggtactgccgacagcgaaaaaagtgacctaccgtattcactttaaacgcattgttaaccgtcgtctgattatgggcctggcggatggcgaagtgctggttgatggtcgtctgatctataccgccagcgacctgaaagtcggtctgttccaggatacgtctgccttctga

SEQ ID NO: 94 - protein, 172 aa, Escherichia coli
MVDKRESYTKEDLLASGRGELFGAKGPQLPAPNMLMMDRVVKMTETGGNFDKGYVEAELDINPDLWFFGCHFIGDPVMPGCLGLDAMWQLVGFYLGWLGGEGKGRALGVGEVKFTGQVLPTAKKVTYRIHFKRIVNRRLIMGLADGEVLVDGRLIYTASDLKVGLFQDTSAF

SEQ ID NO: 95 - DNA, 456 bp, Escherichia coli
ttgactactaacactcatactctgcagattgaagagattttagaacttctgccgcaccgtttcccgttcttactggtggatcgcgtgctggattttgaagaaggtcgttttctgcgcgcagtaaaaaatgtctctgtcaatgagccattcttccagggccatttccctggaaaaccgattttcccgggtgtgctgattctggaagcaatggcacaggcaacaggtattctggcgtttaaaagcgtaggaaaactggaaccgggtgagctgtactacttcgctggtattgacgaagcgcgcttcaagcgcccggtcgtgcctggcgatcaaatgatcatggaagtcactttcgaaaaaacgcgccgcggcctgacccgttttaaaggggttgctctggtcgatggtaaagtagtttgcgaagcaacgatgatgtgtgctcgtagccgggaggcctga

SEQ ID NO: 96 - protein, 151 aa, Escherichia coli
MTTNTHTLQIEEILELLPHRFPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 97 - DNA, 912 bp, Escherichia coli
gtgagtacattagaacaaacaataggcaatacgcctctggtgaagttgcagcgaatggggccggataacggcagtgaagtgtggttaaaactggaaggcaataacccggcaggttcggtgaaagatcgtgcggcactttcgatgatcgtcgaggcggaaaagcgcggggaaattaaaccgggtgatgtcttaatcgaagccaccagtggtaacaccggcattgcgctggcaatgattgccgcgctgaaaggctatcgcatgaaattgctgatgcccgacaacatgagccaggaacgccgtgcggcgatgcgtgcttatggtgcggaactgattcttgtcaccaaagagcagggcatggaaggtgcgcgcgatctggcgctggagatggcgaatcgtggcgaaggaaagctgctcgatcagttcaataatcccgataacccttatgcgcattacaccaccactgggccggaaatctggcagcaaaccggcgggcgcatcactcattttgtctccagcatggggacgaccggcactatcaccggcgtctcacgctttatgcgcgaacaatccaaaccggtgaccattgtcggcctgcaaccggaagagggcagcagcattcccggcattcgccgctggcctacggaatatctgccggggattttcaacgcttctctggtggatgaggtgctggatattcatcagcgcgatgcggaaaacaccatgcgcgaactggcggtgcgggaaggaatattctgtggcgtcagctccggcggcgcggttgccggagcactgcgggtggcaaaagctaaccctgacgcggtggtggtggcgatcatctgcgatcgtggcgatcgctacctttctaccggggtgtttggggaagagcattttagccagggggcggggatttaa

SEQ ID NO: 98 - protein, 303 aa, Escherichia coli
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSRFMREQSKPVTIVGLQPEEGSSIPGIRRWPTEYLPGIFNASLVDEVLDIHQRDAENTMRELAVREGIFCGVSSGGAVAGALRVAKANPDAVVVAIICDRGDRYLSTGVFGEEHFSQGAGI

SEQ ID NO: 99 - DNA, 2046 bp, Escherichia coli
atgcagcagttagccagtttcttatccggtacctggcagtctggccggggccgtagccgtttgattcaccacgctattagcggcgaggcgttatgggaagtgaccagtgaaggtcttgatatggcggctgcccgccagtttgccattgaaaaaggtgcccccgcccttcgcgctatgacctttatcgaacgtgcggcgatgcttaaagcggtcgctaaacatctgctgagtgaaaaagagcgtttctatgctctttctgcgcaaacaggcgcaacgcgggcagacagttgggttgatattgaaggtggcattgggacgttatttacttacgccagcctcggtagccgggagctgcctgacgatacgctgtggccggaagatgaattgatccccttatcgaaagaaggtggatttgccgcgcgccatttactgacctcaaagtcaggcgtggcagtgcatattaacgcctttaacttcccctgctggggaatgctggaaaagctggcaccaacgtggctgggcggaatgccagccatcatcaaaccagctaccgcgacggcccaactgactcaggcgatggtgaaatcaattgtcgatagtggtcttgttcccgaaggcgcaattagtctgatctgcggtagtgctggcgacttgttggatcatctggacagccaggatgtggtgactttcacggggtcagcggcgaccggacagatgctgcgagttcagccaaatatcgtcgccaaatctatccccttcactatggaagctgattccctgaactgctgcgtactgggcgaagatgtcaccccggatcaaccggagtttgcgctgtttattcgtgaagttgtgcgtgagatgaccacaaaagccgggcaaaaatgtacggcaatccggcggattattgtgccgcaggcattggttaatgctgtcagtgatgctctggttgcgcgattacagaaagtcgtggtcggtgatcctgctcaggaaggcgtgaaaatgggcgcactggtaaatgctgagcagcgtgccgatgtgcaggaaaaagtgaacatattgctggctgcaggatgcgagattcgcctcggtggtcaggcggatttatctgctgcgggtgccttcttcccgccaaccttattgtactgtccgcagccggatgaaacaccggcggtacatgcaacagaagcctttggccctgtcgcaacgctgatgccagcacaaaaccagcgacatgctctgcaactggcttgtgcaggcggcggtagccttgcgggaacgctggtgacggctgatccgcaaattgcgcgtcagtttattgccgacgcggcacgtacgcatgggcgaattcagatcctcaatgaagagtcggcaaaagaatccaccgggcatggctccccactgccacaactggtacatggtgggcctggtcgcgcaggaggcggtgaagaattaggcggtttacgagcggtgaaacattacatgcagcgaaccgctgttcagggtagtccgacgatgcttgccgctatcagtaaacagtgggtgcgcggtgcgaaagtcgaagaagatcgtattcatccgttccgcaaatattttgaggagctacaaccaggcgacagcctgttgactccccgccgcacaatgacagaggccgatattgttaactttgcttgcctcagcggcgatcatttctatgcacatatggataagattgctgctgccgaatctattttcggtgagcgggtggtgcatgggtattttgtgctttctgcggctgcgggtctgtttgtcgatgccggtgtcggtccggtcattgctaactacgggctggaaagcttgcgttttatcgaacccgtaaagccaggcgataccatccaggtgcgtctcacctgtaagcgcaagacgctgaaaaaacagcgtagcgcagaagaaaaaccaacaggtgtggtggaatgggctgtagaggtattcaatcagcatcaaaccccggtggcgctgtattcaattctgacgctggtggccaggcagcacggtgattttgtcgattaa

SEQ ID NO: 100 - protein, 681 aa, Escherichia coli
MQQLASFLSGTWQSGRGRSRLIHHAISGEALWEVTSEGLDMAAARQFAIEKGAPALRAMTFIERAAMLKAVAKHLLSEKERFYALSAQTGATRADSWVDIEGGIGTLFTYASLGSRELPDDTLWPEDELIPLSKEGGFAARHLLTSKSGVAVHINAFNFPCWGMLEKLAPTWLGGMPAIIKPATATAQLTQAMVKSIVDSGLVPEGAISLICGSAGDLLDHLDSQDVVTFTGSAATGQMLRVQPNIVAKSIPFTMEADSLNCCVLGEDVTPDQPEFALFIREVVREMTTKAGQKCTAIRRIIVPQALVNAVSDALVARLQKVVVGDPAQEGVKMGALVNAEQRADVQEKVNILLAAGCEIRLGGQADLSAAGAFFPPTLLYCPQPDETPAVHATEAFGPVATLMPAQNQRHALQLACAGGGSLAGTLVTADPQIARQFIADAARTHGRIQILNEESAKESTGHGSPLPQLVHGGPGRAGGGEELGGLRAVKHYMQRTAVQGSPTMLAAISKQWVRGAKVEEDRIHPFRKYFEELQPGDSLLTPRRTMTEADIVNFACLSGDHFYAHMDKIAAAESIFGERVVHGYFVLSAAAGLFVDAGVGPVIANYGLESLRFIEPVKPGDTIQVRLTCKRKTLKKQRSAEEKPTGVVEWAVEVFNQHQTPVALYSILTLVARQHGDFVD

SEQ ID NO: 101 - DNA, 1221 bp, Escherichia coli
atgaaacgtgcagtgattactggcctgggcattgtttccagcatcggtaataaccagcaggaagtcctggcatctctgcgtgaaggacgttcagggatcactttctctcaggagctgaaggattccggcatgcgtagccacgtctggggcaacgtaaaactggataccactggcctcattgaccgcaaagttgtgcgctttatgagcgacgcatccatttatgcattcctttctatggagcaggcaatcgctgatgcgggcctctctccggaagcttaccagaataacccgcgcgttggcctgattgcaggttccggcggcggctccccgcgtttccaggtgttcggcgctgacgcaatgcgcggcccgcgcggcctgaaagcggttggcccgtatgtggtcaccaaagcgatggcatccggcgtttctgcctgcctcgccaccccgtttaaaattcatggcgttaactactccatcagctccgcgtgtgcgacttccgcacactgtatcggtaacgcagtagagcagatccaactgggcaaacaggacatcgtgtttgctggcggcggcgaagagctgtgctgggaaatggcttgcgaattcgacgcaatgggtgcgctgtctactaaatacaacgacaccccggaaaaagcctcccgtacttacgacgctcaccgtgacggtttcgttatcgctggcggcggcggtatggtagtggttgaagagctggaacacgcgctggcgcgtggtgctcacatctatgctgaaatcgttggctacggcgcaacctctgatggtgcagacatggttgctccgtctggcgaaggcgcagtacgctgcatgaagatggcgatgcatggcgttgataccccaatcgattacctgaactcccacggtacttcgactccggttggcgacgtgaaagagctggcagctatccgtgaagtgttcggcgataagagcccggcgatttctgcaaccaaagccatgaccggtcactctctgggcgctgctggcgtacaggaagctatctactctctgctgatgctggaacacggctttatcgccccgagcatcaacattgaagagctggacgagcaggctgcgggtctgaacatcgtgaccgaaacgaccgatcgcgaactgaccaccgttatgtctaacagcttcggcttcggcggcaccaacgccacgctggtaatgcgcaagctgaaagattaa

SEQ ID NO: 102 - protein, 406 aa, Escherichia coli
MKRAVITGLGIVSSIGNNQQEVLASLREGRSGITFSQELKDSGMRSHVWGNVKLDTTGLIDRKVVRFMSDASIYAFLSMEQAIADAGLSPEAYQNNPRVGLIAGSGGGSPRFQVFGADAMRGPRGLKAVGPYVVTKAMASGVSACLATPFKIHGVNYSISSACATSAHCIGNAVEQIQLGKQDIVFAGGGEELCWEMACEFDAMGALSTKYNDTPEKASRTYDAHRDGFVIAGGGGMVVVEELEHALARGAHIYAEIVGYGATSDGADMVAPSGEGAVRCMKMAMHGVDTPIDYLNSHGTSTPVGDVKELAAIREVFGDKSPAISATKAMTGHSLGAAGVQEAIYSLLMLEHGFIAPSINIEELDEQAAGLNIVTETTDRELTTVMSNSFGFGGTNATLVMRKLKD

SEQ ID NO: 103 - DNA, 1242 bp, Escherichia coli
gtgtctaagcgtcgtgtagttgtgaccggactgggcatgttgtctcctgtcggcaataccgtagagtctacctggaaagctctgcttgccggtcagagtggcatcagcctaatcgaccatttcgatactagcgcctatgcaacgaaatttgctggcttagtaaaggattttaactgtgaggacattatctcgcgcaaagaacagcgcaagatggatgccttcattcaatatggaattgtcgctggcgttcaggccatgcaggattctggccttgaaataacggaagagaacgcaacccgcattggtgccgcaattggctccgggattggcggcctcggactgatcgaagaaaaccacacatctctgatgaacggtggtccacgtaagatcagcccattcttcgttccgtcaacgattgtgaacatggtggcaggtcatctgactatcatgtatggcctgcgtggcccgagcatctctatcgcgactgcctgtacttccggcgtgcacaacattggccatgctgcgcgtattatcgcgtatggcgatgctgacgtgatggttgcaggtggcgcagagaaagccagtacgccgctgggcgttggtggttttggcgcggcacgtgcattatctacccgcaatgataacccgcaagcggcgagccgcccgtgggataaagagcgtgatggtttcgtactgggcgatggtgccggtatgctggtacttgaagagtacgaacacgcgaaaaaacgcggtgcgaaaatttacgctgaactcgtcggctttggtatgagcagcgatgcttatcatatgacgtcaccgccagaaaatggcgcaggcgcagctctggcgatggcaaatgctctgcgtgatgcaggcattgaagcgagtcagattggctacgttaacgcgcacggtacttctacgccggctggcgataaagctgaagcgcaggcggtgaaaaccatcttcggtgaagctgcaagccgtgtgttggtaagctccacgaaatctatgaccggtcacctgttaggtgcggcgggtgcagtagaatctatctactccatcctggcgctgcgcgatcaggctgttccgccaaccatcaacctggataacccggatgaaggttgcgatctggatttcgtaccgcacgaagcgcgtcaggttagcggaatggaatacactctgtgtaactccttcggcttcggtggcactaatggttctttgatctttaaaaagatctaa

SEQ ID NO: 104 - protein, 413 aa, Escherichia coli
MSKRRVVVTGLGMLSPVGNTVESTWKALLAGQSGISLIDHFDTSAYATKFAGLVKDFNCEDIISRKEQRKMDAFIQYGIVAGVQAMQDSGLEITEENATRIGAAIGSGIGGLGLIEENHTSLMNGGPRKISPFFVPSTIVNMVAGHLTIMYGLRGPSISIATACTSGVHNIGHAARIIAYGDADVMVAGGAEKASTPLGVGGFGAARALSTRNDNPQAASRPWDKERDGFVLGDGAGMLVLEEYEHAKKRGAKIYAELVGFGMSSDAYHMTSPPENGAGAALAMANALRDAGIEASQIGYVNAHGTSTPAGDKAEAQAVKTIFGEAASRVLVSSTKSMTGHLLGAAGAVESIYSILALRDQAVPPTINLDNPDEGCDLDFVPHEARQVSGMEYTLCNSFGFGGTNGSLIFKKI

SEQ ID NO: 105 - DNA, 2145 bp, Escherichia coli
atggaaatgacatcagcgtttacccttaatgttcgtctggacaacattgccgttatcaccatcgacgtaccgggtgagaaaatgaataccctgaaggcggagtttgcctcgcaggtgcgcgccattattaagcaactccgtgaaaacaaagagttgcgaggcgtggtgtttgtctccgctaaaccggacaacttcattgctggcgcagacatcaacatgatcggcaactgcaaaacggcgcaagaagcggaagctctggcgcggcagggccaacagttgatggcggagattcatgctttgcccattcaggttatcgcggctattcatggcgcttgcctgggtggtgggctggagttggcgctggcgtgccacggtcgcgtttgtactgacgatcctaaaacggtgctcggtttgcctgaagtacaacttggattgttacccggttcaggcggcacccagcgtttaccgcgtctgataggcgtcagcacagcattagagatgatcctcaccggaaaacaacttcgggcgaaacaggcattaaagctggggctggtggatgacgttgttccgcactccattctgctggaagccgctgttgagctggcaaagaaggagcgcccatcttcccgccctctacctgtacgcgagcgtattctggcggggccgttaggtcgtgcgctgctgttcaaaatggtcggcaagaaaacagaacacaaaactcaaggcaattatccggcgacagaacgcatcctggaggttgttgaaacgggattagcgcagggcaccagcagcggttatgacgccgaagctcgggcgtttggcgaactggcgatgacgccacaatcgcaggcgctgcgtagtatcttttttgccagtacggacgtgaagaaagatcccggcagtgatgcgccgcctgcgccattaaacagcgtggggattttaggtggtggcttgatgggcggcggtattgcttatgtcactgcttgtaaagcggggattccggtcagaattaaagatatcaacccgcagggcataaatcatgcgctgaagtacagttgggatcagctggagggcaaagttcgccgtcgtcatctcaaagccagcgaacgtgacaaacagctggcattaatctccggaacgacggactatcgcggctttgcccatcgcgatctgattattgaagcggtgtttgaaaatctcgaattgaaacaacagatggtggcggaagttgagcaaaattgcgccgctcataccatctttgcttcgaatacgtcatctttaccgattggtgatatcgccgctcacgccacgcgacctgagcaagttatcggcctgcatttcttcagtccggtggaaaaaatgccgctggtggagattattcctcatgcggggacatcggcgcaaaccatcgctaccacagtaaaactggcgaaaaaacagggtaaaacgccaattgtcgtgcgtgacaaagccggtttttacgtcaatcgcatcttagcgccttacattaatgaagctatccgcatgttgacccaaggtgaacgggtagagcacattgatgccgcgctagtgaaatttggttttccggtaggcccaatccaacttttggatgaggtaggaatcgacaccgggactaaaattattcctgtactggaagccgcttatggagaacgttttagcgcgcctgcaaatgttgtttcttcaattttgaacgacgatcgcaaaggcagaaaaaatggccggggtttctatctttatggtcagaaagggcgtaaaagcaaaaaacaggtcgatcccgccatttacccgctgattggcacacaagggcaggggcgaatctccgcaccgcaggttgctgaacggtgtgtgatgttgatgctgaatgaagcagtacgttgtgttgatgagcaggttatccgtagcgtgcgtgacggggatattggcgcggtatttggcattggttttccgccatttctcggtggaccgttccgctatatcgattctctcggcgcgggcgaagtggttgcaataatgcaacgacttgccacgcagtatggttcccgttttaccccttgcgagcgtttggtcgagatgggcgcgcgtggggaaagtttttggaaaacaactgcaactgacctgcaataa

SEQ ID NO: 106 - protein, 714 aa, Escherichia coli
MEMTSAFTLNVRLDNIAVITIDVPGEKMNTLKAEFASQVRAIIKQLRENKELRGVVFVSAKPDNFIAGADINMIGNCKTAQEAEALARQGQQLMAEIHALPIQVIAAIHGACLGGGLELALACHGRVCTDDPKTVLGLPEVQLGLLPGSGGTQRLPRLIGVSTALEMILTGKQLRAKQALKLGLVDDVVPHSILLEAAVELAKKERPSSRPLPVRERILAGPLGRALLFKMVGKKTEHKTQGNYPATERILEVVETGLAQGTSSGYDAEARAFGELAMTPQSQALRSIFFASTDVKKDPGSDAPPAPLNSVGILGGGLMGGGIAYVTACKAGIPVRIKDINPQGINHALKYSWDQLEGKVRRRHLKASERDKQLALISGTTDYRGFAHRDLIIEAVFENLELKQQMVAEVEQNCAAHTIFASNTSSLPIGDIAAHATRPEQVIGLHFFSPVEKMPLVEIIPHAGTSAQTIATTVKLAKKQGKTPIVVRDKAGFYVNRILAPYINEAIRMLTQGERVEHIDAALVKFGFPVGPIQLLDEVGIDTGTKIIPVLEAAYGERFSAPANVVSSILNDDRKGRKNGRGFYLYGQKGRKSKKQVDPAIYPLIGTQGQGRISAPQVAERCVMLMLNEAVRCVDEQVIRSVRDGDIGAVFGIGFPPFLGGPFRYIDSLGAGEVVAIMQRLATQYGSRFTPCERLVEMGARGESFWKTTATDLQ

SEQ ID NO: 107 - DNA, 897 bp, Escherichia coli
atgaccgatttacacaccgatgtagaacgctacctacgttatctgagcgtggagcgccagcttagcccgataaccctgcttaactaccagcgtcagcttgaggcgatcatcaattttgccagcgaaaacggcctgcaaagctggcagcaatgtgatgtgacgatggtgcgcaattttgctgtacgcagtcgccgtaaagggctgggagcagcaagtctggcgttacggctttctgcgctacgtagcttttttgactggctggtcagccagaacgaactcaaagctaacccggcgaaaggtgtttcggcaccgaaagcgccgcgtcatctgccgaaaaacatcgacgtcgacgatatgaatcggctgctggatattgatatcaatgatcccctcgctgtacgcgaccgtgcaatgctggaagtgatgtacggcgcgggtctgcgtctttctgagctggtggggctggatattaaacacctcgacctggagtctggtgaagtgtgggttatggggaaaggcagcaaagagcgccgcctgccgattggtcgcaacgctgtggcgtggattgagcactggcttgatttgcgcgacctgtttggtagcgaagacgacgcgctttttctgtcgaaactgggcaagcgtatctccgcgcgtaatgtgcagaaacgctttgccgaatggggcataaaacaagggctgaataatcacgttcatccgcataaattacgtcactcgttcgccacgcatatgctggagtcgagcggcgatcttcgtggtgtgcaggagctgctgggtcatgccaacctctccaccacgcaaatctatactcatcttgattttcaacaccttgcctcggtgtacgatgcggcgcatccacgcgccaaacgggggaaataa

SEQ ID NO: 108 - protein, 298 aa, Escherichia coli
MTDLHTDVERYLRYLSVERQLSPITLLNYQRQLEAIINFASENGLQSWQQCDVTMVRNFAVRSRRKGLGAASLALRLSALRSFFDWLVSQNELKANPAKGVSAPKAPRHLPKNIDVDDMNRLLDIDINDPLAVRDRAMLEVMYGAGLRLSELVGLDIKHLDLESGEVWVMGKGSKERRLPIGRNAVAWIEHWLDLRDLFGSEDDALFLSKLGKRISARNVQKRFAEWGIKQGLNNHVHPHKLRHSFATHMLESSGDLRGVQELLGHANLSTTQIYTHLDFQHLASVYDAAHPRAKRGK

SEQ ID NO: 109 - DNA, 1182 bp, Escherichia coli
atgaaagacgttgtgattgtcggggcgttacggacacctatcggctgctttcgtggtgcgttagcgggtcattccgccgtggaacttggtagtctggtcgtgaaagcgttaatagaacgtaccggcgttcctgcatatgcggtggatgaagtaattcttggtcaggtgttgactgcaggggcagggcagaatccggcaaggcaatcggctattaaaggtggtctgcctaatagcgtttctgcaatcactattaatgacgtttgcggttccgggcttaaagcactgcatctggctactcaggcgatacagtgtggcgaggctgatattgtcatcgccggtggccaggaaaacatgagccgcgcaccacatgttctgactgatagccgcaccggtgcacagcttggcaatagccagttggttgacagtcttgtgcatgatgggttgtgggatgccttcaatgattatcatattggtgtcaccgccgaaaatctggctcgcgaatatggcatcagccgtcagttgcaggatgcttacgcacttagctcgcaacaaaaagcgcgagcggcgattgacgccggacgatttaaagatgagatcgtcccggtaatgacccaaagtaacgggcagacgttggttgttgataccgatgaacagccacgcactgacgccagcgcagaaggcttagcccgtttaaatccttcatttgatagtctcggttctgtgacagcgggtaatgcatcatccataaacgatggcgcagctgcggtaatgatgatgagcgaagccaaagcacgagcgttgaatttacccgtgctggcccgcattcgcgcatttgccagcgttggtgtagatccggcattgatgggaattgcgccggtgtatgcgacccgccgttgcctggagcgtgtaggctggcagttggctgaagtcgatcttatcgaggctaatgaagcgtttgctgcacaggcgctttcggttggcaagatgcttgagtgggatgagcgtcgggtcaatgtcaatggtggcgcgatcgcactcggtcacccgataggcgcttccggttgccgaatcctggtttctctggttcatgaaatggtgaaacgtaatgcccgcaaaggactggcaacgctttgtatcggcgggggccagggtgtggcattgaccattgaacgtgacgaatag

SEQ ID NO: 110 - protein, 393 aa, Escherichia coli
MKDVVIVGALRTPIGCFRGALAGHSAVELGSLVVKALIERTGVPAYAVDEVILGQVLTAGAGQNPARQSAIKGGLPNSVSAITINDVCGSGLKALHLATQAIQCGEADIVIAGGQENMSRAPHVLTDSRTGAQLGNSQLVDSLVHDGLWDAFNDYHIGVTAENLAREYGISRQLQDAYALSSQQKARAAIDAGRFKDEIVPVMTQSNGQTLVVDTDEQPRTDASAEGLARLNPSFDSLGSVTAGNASSINDGAAAVMMMSEAKARALNLPVLARIRAFASVGVDPALMGIAPVYATRRCLERVGWQLAEVDLIEANEAFAAQALSVGKMLEWDERRVNVNGGAIALGHPIGASGCRILVSLVHEMVKRNARKGLATLCIGGGQGVALTIERDE

SEQ ID NO: 111 - DNA, 897 bp, Escherichia coli
atgcaatttgaaaagatgattactgaaggctcgaacaccgcctcggctgaaattgaccgcgtatcgacgctggaaatgtgccggattatcaacgatgaagataaaaccgtaccgcttgccgttgagcgcgtactgccggatatcgccgcggcgatcgatgttatccacgcccaggtaagcggcggcgggcgtctgatttacctcggtgcgggaacatccggtcgtctggggattctggatgccagcgaatgtccgcccacctacggcgtgaaaccgggtctggtggttggtttgattgctggcggcgaatatgccattcagcacgcggtggaaggcgcggaagatagccgggaaggcggtgttaatgatctgaaaaatattaatttaacggcacaggatgtggtggttggcattgctgccagcggtcgcacgccgtatgtgattgccggactggaatacgcacgccagctcggctgccgcacagtgggaatttcctgtaatccggggagcgccgtttcaaccaccgctgagtttgccattacaccgattgtaggtgccgaagttgttaccggttcttcgcggatgaaagcaggtacagcgcagaaactggtgctcaatatgctttccaccgggctgatgattaaatccggcaaagtgttcggcaacctgatggtcgatgtggtcgccaccaacgaaaaactgcatgtgcgacaggtcaatattgttaaaaacgccaccggatgtagcgcagagcaagcggaagcggcgttaattgcttgcgagcgcaactgtaaaacggccattgtgatggtgctgaaaaatctcgatgccgcagaagctaaaaaacgcctggatcaacacggcggctttattcgtcaggttttagacaaggaataa

SEQ ID NO: 112 - protein, 298 aa, Escherichia coli
MQFEKMITEGSNTASAEIDRVSTLEMCRIINDEDKTVPLAVERVLPDIAAAIDVIHAQVSGGGRLIYLGAGTSGRLGILDASECPPTYGVKPGLVVGLIAGGEYAIQHAVEGAEDSREGGVNDLKNINLTAQDVVVGIAASGRTPYVIAGLEYARQLGCRTVGISCNPGSAVSTTAEFAITPIVGAEVVTGSSRMKAGTAQKLVLNMLSTGLMIKSGKVFGNLMVDVVATNEKLHVRQVNIVKNATGCSAEQAEAALIACERNCKTAIVMVLKNLDAAEAKKRLDQHGGFIRQVLDKE

SEQ ID NO: 113 - DNA, 3507 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgacttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 114 - protein, 1168 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLTYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 115 - DNA, 3282 bp, Mycobacterium tuberculosis
atggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 116 - protein, 1093 aa, Mycobacterium tuberculosis
MVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 117 - DNA, 3126 bp, Mycobacterium tuberculosis
gacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctggccgacaccagctataccggtcagctcaacctgccggacatgttcacccggctgatgctgagcctggccgctaccggcatcgcacccggttcgttctatgagctggatgcgcacggcaatcggcaacgcgcccactatgacggcttgccggtcgaattcgtcgcagaagccatttgcacccttgggacacatagcccggaccgttttgtcacctaccacgtgatgaacccctacgacgacggcatcgggctggacgagttcgtcgactggctcaactccccaactagcgggtccggttgcacgatccagcggatcgccgactacggcgagtggctgcagcggttcgagacttcgctgcgtgccttgccggatcgccagcgccacgcctcgctgctgcccttgctgcacaactaccgagagcctgcaaagccgatatgcgggtcaatcgcgcccaccgaccagttccgcgctgccgtccaagaagcgaaaatcggtccggacaaagacattccgcacctcacggcggcgatcatcgcgaagtacatcagcaacctgcgactgctcgggctgctgtga

SEQ ID NO: 118 - protein, 1041 aa, Mycobacterium tuberculosis
DIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILADTSYTGQLNLPDMFTRLMLSLAATGIAPGSFYELDAHGNRQRAHYDGLPVEFVAEAICTLGTHSPDRFVTYHVMNPYDDGIGLDEFVDWLNSPTSGSGCTIQRIADYGEWLQRFETSLRALPDRQRHASLLPLLHNYREPAKPICGSIAPTDQFRAAVQEAKIGPDKDIPHLTAAIIAKYISNLRLLGLL

SEQ ID NO: 119 - DNA, 3000 bp, Mycobacterium tuberculosis
atgtcgatcaacgatcagcgactgacacgccgcgtcgaggacctatacgccagcgacgcccagttcgccgccgccagtcccaacgaggcgatcacccaggcgatcgaccagcccggggtcgcgcttccacagctcatccgtatggtcatggagggctacgccgatcggccggcactcggccagcgtgcgctccgcttcgtcaccgaccccgacagcggccgcaccatggtcgagctactgccgcggttcgagaccatcacctaccgcgaactgtgggcccgcgccggcacattggccaccgcgttgagcgctgagcccgcgatccggccgggcgaccgggtttgcgtgctgggcttcaacagcgtcgactacacaaccatcgacatcgcgctgatccggttgggcgccgtgtcggttccactgcagaccagtgcgccggtcaccgggttgcgcccgatcgtcaccgagaccgagccgacgatgatcgccaccagcatcgacaatcttggcgacgccgtcgaagtgctggccggtcacgccccggcccggctggtcgtattcgattaccacggcaaggttgacacccaccgcgaggccgtcgaagccgcccgagctcggttggccggctcggtgaccatcgacacacttgccgaactgatcgaacgcggcagggcgctgccggccacacccattgccgacagcgccgacgacgcgctggcgctgctgatttacacctcgggtagtaccggcgcacccaaaggcgccatgtatcgcgagagccaggtgatgagcttctggcgcaagtcgagtggctggttcgagccgagcggttacccctcgatcacgctgaacttcatgccgatgagccacgtcgggggccgtcaggtgctctacgggacgctttccaacggcggtaccgcctacttcgtcgccaagagcgacctgtcgacgctgttcgaggacctcgccctggtgcggcccacagaattgtgcttcgtgccgcgcatctgggacatggtgttcgcagagttccacagcgaggtcgaccgccgcttggtggacggcgccgatcgagcggcgctggaagcgcaggtgaaggccgagctgcgggagaacgtgctcggcggacggtttgtcatggcgctgaccggttccgcgccgatctccgctgagatgacggcgtgggtcgagtccctgctggccgacgtgcatttggtggagggttacggctccaccgaggccgggatggtcctgaacgacggcatggtgcggcgccccgcggtgatcgactacaagctggtcgacgtgcccgagctgggctacttcggcaccgatcagccctacccccggggcgagctgctggtcaagacgcaaaccatgttccccggctactaccagcgcccggatgtcaccgccgaggtgttcgaccccgacggcttctaccggaccggggacatcatggccaaagtaggccccgaccagttcgtctacctcgaccgccgcaacaacgtgctaaagctctcccagggcgagttcatcgccgtgtcgaagctcgaggcggtgttcggcgacagcccgctggtccgacagatcttcatctacggcaacagtgcccgggcctacccgctggcggtggttgtcccgtccggggacgcgctttctcgccatggcatcgagaatctcaagcccgtgatcagcgagtccctgcaggaggtagcgagggcggccggcctgcaatcctacgagattccacgcgacttcatcatcgaaaccacgccgttcaccctggagaacggcctgctcaccggcatccgcaagctggcacgcccgcagttgaagaagttctatggcgaacgtctcgagcggctctataccgagctggccgatagccaatccaacgagctgcgcgagctgcggcaaagcggtcccgatgcgccggtgcttccgacgctgtgccgtgccgcggctgcgttgctgggctctaccgctgcggatgtgcggccggacgcgcacttcgccgacctgggtggtgactcgctctcggcgctgtcgttggccaacctgctgcacgagatcttcggcgtcgacgtgccggtgggtgtcattgtcagcccggcaagcgacctgcgggccctggccgaccacatcgaagcagcgcgcaccggcgtcaggcgacccagcttcgcctcgatacacggtcgctccgcgacggaagtgcacgccagcgacctcacgctggacaagttcatcgacgctgccaccctggccgcagccccgaacctgccggcaccgagcgcccaagtgcgcaccgtactgctgaccggcgccaccggctttttgggtcgctacctggcgctggaatggctcgaccgcatggacctggtcaacggcaagctgatctgcctggtccgcgccagatccgacgaggaagcacaagcccggctggacgcgacgttcgatagcggcgacccgtatttggtgcggcactaccgcgaattgggcgccggccgcctcgaggtgctcgccggcgacaagggcgaggccgacctgggcctggaccgggtcacctggcagcggctagccgacacggtggacctgatcgtggaccccgcggccctggtcaaccacgtgctgccgtatagccagctgttcggcccaaacgcggcgggcaccgccgagttgcttcggctggcgctgaccggcaagcgcaagccatacatctacacctcgacgatcgccgtgggcgagcagatcccgccggaggcgttcaccgaggacgccgacatccgggccatcagcccgacccgcaggatcgacgacagctacgccaacggctacgcgaacagcaagtgggccggcgaggtgctgctgcgcgaagctcacgagcagtgcggcctgccggtgacggtcttccgctgcgacatgatcctgggccgacaccagctataccggtcagctcaacctgccggacatgtcacccgggctgatgctgagcctggc

SEQ ID NO: 120 - protein, 1000 aa, Mycobacterium tuberculosis
MSINDQRLTRRVEDLYASDAQFAAASPNEAITQAIDQPGVALPQLIRMVMEGYADRPALGQRALRFVTDPDSGRTMVELLPRFETITYRELWARAGTLATALSAEPAIRPGDRVCVLGFNSVDYTTIDIALIRLGAVSVPLQTSAPVTGLRPIVTETEPTMIATSIDNLGDAVEVLAGHAPARLVVFDYHGKVDTHREAVEAARARLAGSVTIDTLAELIERGRALPATPIADSADDALALLIYTSGSTGAPKGAMYRESQVMSFWRKSSGWFEPSGYPSITLNFMPMSHVGGRQVLYGTLSNGGTAYFVAKSDLSTLFEDLALVRPTELCFVPRIWDMVFAEFHSEVDRRLVDGADRAALEAQVKAELRENVLGGRFVMALTGSAPISAEMTAWVESLLADVHLVEGYGSTEAGMVLNDGMVRRPAVIDYKLVDVPELGYFGTDQPYPRGELLVKTQTMFPGYYQRPDVTAEVFDPDGFYRTGDIMAKVGPDQFVYLDRRNNVLKLSQGEFIAVSKLEAVFGDSPLVRQIFIYGNSARAYPLAVVVPSGDALSRHGIENLKPVISESLQEVARAAGLQSYEIPRDFIIETTPFTLENGLLTGIRKLARPQLKKFYGERLERLYTELADSQSNELRELRQSGPDAPVLPTLCRAAAALLGSTAADVRPDAHFADLGGDSLSALSLANLLHEIFGVDVPVGVIVSPASDLRALADHIEAARTGVRRPSFASIHGRSATEVHASDLTLDKFIDAATLAAAPNLPAPSAQVRTVLLTGATGFLGRYLALEWLDRMDLVNGKLICLVRARSDEEAQARLDATFDSGDPYLVRHYRELGAGRLEVLAGDKGEADLGLDRVTWQRLADTVDLIVDPAALVNHVLPYSQLFGPNAAGTAELLRLALTGKRKPYIYTSTIAVGEQIPPEAFTEDADIRAISPTRRIDDSYANGYANSKWAGEVLLREAHEQCGLPVTVFRCDMILGRHQLYRSAQPAGHVTRADAEPG

SEQ ID NO: 121 - DNA, 3525 bp, Mycobacterium intracellulare; identical to SEQ ID NO: 33

SEQ ID NO: 122 - protein, 1174 aa, Mycobacterium intracellulare; identical to SEQ ID NO: 34

The invention claimed is:

1. A method of producing a fatty aldehyde, the method comprising:

(a) providing a bacterial host cell, said bacterial host cell engineered to express a gene encoding a polypeptide having at least 90% sequence identity to the amino acid sequence of SEQ ID NO: 22 (carB), and comprising the phosphopantetheine attachment site sequence of SEQ ID NO: 9, wherein the polypeptide has carboxylic acid reductase activity effective to convert a fatty acid to a fatty aldehyde; and (b) culturing said engineered bacterial host cell in a culture media containing a carbohydrate carbon source under conditions effective to produce a fatty aldehyde at a yield of at least 25 mg/L in the media of the bacterial host cell culture, when cultured for 20 hours at 37° C.

2. The method of claim 1, further comprising modifying the expression of a gene encoding a polypeptide having fatty acid synthase activity in the bacterial host cell.

3. The method of claim 2, wherein said gene encodes a polypeptide having thioesterase activity.

4. The method of claim 1, wherein the bacterial host cell is genetically engineered to express an attenuated level of a fatty acid degradation enzyme relative to a wild type bacterial host cell.

5. A method of producing a fatty aldehyde, the method comprising:

(a) providing a bacterial host cell, engineering said bacterial host cell engineered to comprise a recombinant vector comprising a nucleotide sequence having the nucleotide sequence of SEQ ID NO: 21, wherein the nucleotide sequence encodes a polypeptide having carboxylic acid reductase activity which comprises the phosphopantetheine attachment site sequence of SEQ ID NO: 9, and (b) culturing said engineered bacterial host cell in a culture media containing a carbohydrate carbon source under conditions effective to produce a fatty aldehyde at a yield of at least 25 mg/L in the media of the bacterial host cell culture, when cultured for 20 hours at 37° C.

6. The method of claim 5, further comprising modifying the expression of a gene encoding a polypeptide having fatty acid synthase activity in the bacterial host cell.

7. The method of claim 6, wherein said gene encodes a polypeptide having thioesterase activity.

8. The method of claim 5, wherein the bacterial host cell is a genetically engineered bacterial host cell that expresses an attenuated level of a fatty acid degradation enzyme relative to a wild type bacterial host cell, wherein the fatty acid degradation enzyme has acyl-CoA synthase (EC 2.3.1.86) activity.

9. The method of claim 1, wherein the fatty aldehyde is isolated from the extracellular environment of the bacterial host cell.

10. The method of claim 1, wherein the fatty aldehyde comprises a $C_6$-$C_{26}$ fatty aldehyde.

11. The method of claim 10, wherein the fatty aldehyde is decanal, dodecanal, myristal, or hexadecal.

12. The method of claim 1, wherein the fatty aldehyde is an unsaturated fatty aldehyde.

13. The method of claim 1, wherein the fatty aldehyde is a saturated fatty aldehyde.

14. The method of claim 1, wherein said carbohydrate carbon source is a monosaccharide.

15. The method of claim 14, wherein said monosaccharide is glucose.

16. The method of claim 15, wherein the fatty aldehyde is extracted from the culture media.

17. The method of claim 1, wherein the polypeptide comprises the reductase domain sequence of SEQ ID NO: 7, the NADP binding domain sequence of SEQ ID NO: 8 and the AMP binding domain sequence of SEQ ID NO: 10.

18. The method of claim 1, wherein the polypeptide comprises an amino acid sequence having at least 95% sequence identity to the amino acid sequence of SEQ ID NO: 22.

19. The method of claim 1, wherein the polypeptide comprises the amino acid sequence of SEQ ID NO: 22.

20. The method of claim 4, wherein the fatty acid degradation enzyme has acyl-CoA synthase (EC 2.3.1.86) activity.

* * * * *